(12) United States Patent
Kamb et al.

(10) Patent No.: US 11,602,543 B2
(45) Date of Patent: Mar. 14, 2023

(54) COMPOSITIONS AND METHODS FOR TREATING MESOTHELIN POSITIVE CANCERS

(71) Applicant: A2 Biotherapeutics, Inc., Agoura Hills, CA (US)

(72) Inventors: Carl Alexander Kamb, Agoura Hills, CA (US); Dora Toledo Warshaviak, Oak Park, CA (US); Talar Tokatlian, Agoura Hills, CA (US); Agnes Hamburger, Newbury Park, CA (US)

(73) Assignee: A2 Biotherapeutics, Inc., Agoura Hills, CA (US)

( * ) Notice: Subject to any disclaimer, the term of this patent is extended or adjusted under 35 U.S.C. 154(b) by 0 days.

(21) Appl. No.: 17/662,766

(22) Filed: May 10, 2022

(65) Prior Publication Data

US 2022/0370497 A1    Nov. 24, 2022

Related U.S. Application Data

(63) Continuation of application No. PCT/US2021/046751, filed on Aug. 19, 2021.

(60) Provisional application No. 63/085,971, filed on Sep. 30, 2020, provisional application No. 63/068,245, filed on Aug. 20, 2020.

(51) Int. Cl.
*A61K 35/17* (2015.01)
*C07K 14/725* (2006.01)
*C12N 15/113* (2010.01)
*A61P 35/00* (2006.01)
*A61K 38/00* (2006.01)

(52) U.S. Cl.
CPC .............. *A61K 35/17* (2013.01); *A61P 35/00* (2018.01); *C07K 14/7051* (2013.01); *C12N 15/1138* (2013.01); *A61K 38/00* (2013.01); *C07K 2317/622* (2013.01); *C07K 2319/03* (2013.01); *C12N 2310/531* (2013.01)

(58) Field of Classification Search
CPC .................................................. A61K 35/17
See application file for complete search history.

(56) References Cited

U.S. PATENT DOCUMENTS

| | | | |
|---|---|---|---|
| 4,690,915 A | 9/1987 | Rosenberg |
| 5,350,674 A | 9/1994 | Boenisch et al. |
| 5,585,362 A | 12/1996 | Wilson et al. |
| 5,858,358 A | 1/1999 | June et al. |
| 5,883,223 A | 3/1999 | Gray |
| 6,326,193 B1 | 12/2001 | Liu et al. |
| 6,352,694 B1 | 3/2002 | June et al. |
| 6,534,055 B1 | 3/2003 | June et al. |
| 6,692,964 B1 | 2/2004 | June et al. |
| 6,797,514 B2 | 9/2004 | Berenson et al. |
| 6,809,184 B1 | 10/2004 | Pastan et al. |
| 6,867,041 B2 | 3/2005 | Berenson et al. |
| 6,887,466 B2 | 5/2005 | June et al. |
| 6,905,680 B2 | 6/2005 | June et al. |
| 6,905,681 B1 | 6/2005 | June et al. |
| 6,905,874 B2 | 6/2005 | Berenson et al. |
| 7,067,318 B2 | 6/2006 | June et al. |
| 7,144,575 B2 | 12/2006 | June et al. |
| 7,172,869 B2 | 2/2007 | June et al. |
| 7,175,843 B2 | 2/2007 | June et al. |
| 7,232,566 B2 | 6/2007 | June et al. |
| 7,790,858 B2 | 9/2010 | Presta |
| 8,012,714 B2 | 9/2011 | Gallo et al. |
| 8,642,742 B2 | 2/2014 | Hofer et al. |
| 8,697,359 B1 | 4/2014 | Zhang |
| 8,771,945 B1 | 7/2014 | Zhang |
| 8,795,965 B2 | 8/2014 | Zhang |
| 8,865,406 B2 | 10/2014 | Zhang et al. |
| 8,871,445 B2 | 10/2014 | Cong et al. |
| 9,206,260 B2 | 12/2015 | Hofer et al. |
| 9,745,368 B2 | 8/2017 | Milone et al. |
| 10,040,846 B2 | 8/2018 | Frigault et al. |
| 10,172,885 B2 | 1/2019 | Pule et al. |
| 10,172,886 B2 | 1/2019 | Pule et al. |
| 11,254,726 B2 | 2/2022 | Kamb et al. |
| 2002/0018750 A1 | 2/2002 | Hansen et al. |
| 2003/0091561 A1 | 5/2003 | Van et al. |
| 2003/0170238 A1 | 9/2003 | Gruenberg et al. |
| 2004/0101519 A1 | 5/2004 | June et al. |
| 2005/0244858 A1 | 11/2005 | Rossi et al. |
| 2006/0034810 A1 | 2/2006 | Riley et al. |
| 2006/0121005 A1 | 6/2006 | Berenson et al. |
| 2009/0053184 A1 | 2/2009 | Morgan et al. |
| 2011/0104148 A1 | 5/2011 | Moessner et al. |
| 2012/0009162 A1 | 1/2012 | Yasukawa et al. |

(Continued)

FOREIGN PATENT DOCUMENTS

| | | |
|---|---|---|
| CA | 2904265 A1 | 9/2014 |
| EP | 2681244 B1 | 11/2017 |

(Continued)

OTHER PUBLICATIONS

European Search Report corresponding to European Patent Application No. 17855171.9, dated Mar. 26, 2020, 8 pages.
International Search Report and Written Opinion issued in International Application No. PCT/US2020/045228, dated Dec. 21, 2020, 17 pages.
International Search Report and Written Opinion issued in International Application No. PCT/US2020/064607, dated Mar. 12, 2021, 11 pages.

(Continued)

*Primary Examiner* — Scott Long
(74) *Attorney, Agent, or Firm* — Mintz Levin Cohn Ferris Glovsky and Popeo, P.C.; James Whittle; Anna Mirôn

(57) ABSTRACT

The disclosure provides immune cells comprising a first activator receptor specific to mesothelin and a second inhibitory receptor specific to a ligand that has been lost in a mesothelin-positive cancer cell, and methods of making and using same for the treatment of cancer.

27 Claims, 50 Drawing Sheets
Specification includes a Sequence Listing.

(56) References Cited

U.S. PATENT DOCUMENTS

| | | |
|---|---|---|
| 2014/0068797 A1 | 3/2014 | Doudna et al. |
| 2015/0031624 A1 | 1/2015 | Feldman et al. |
| 2015/0376296 A1 | 12/2015 | Fedorov et al. |
| 2016/0075795 A1 | 3/2016 | Mössner et al. |
| 2016/0108131 A1 | 4/2016 | Berne et al. |
| 2016/0145354 A1 | 5/2016 | Bacac et al. |
| 2016/0229923 A1 | 8/2016 | Hofer et al. |
| 2016/0289293 A1 | 10/2016 | Pulé et al. |
| 2017/0283775 A1 | 10/2017 | June et al. |
| 2017/0296623 A1 | 10/2017 | Juillerat et al. |
| 2017/0355781 A1 | 12/2017 | Markel et al. |
| 2018/0044399 A1 | 2/2018 | Rajpal et al. |
| 2018/0079827 A1 | 3/2018 | Hofer et al. |
| 2018/0346541 A1 | 12/2018 | Wong et al. |
| 2019/0023761 A1 | 1/2019 | Pulé et al. |
| 2019/0185583 A1 | 6/2019 | Hofer et al. |
| 2019/0185849 A1 | 6/2019 | Lundberg et al. |
| 2019/0211076 A1 | 7/2019 | Bleakley et al. |
| 2019/0248869 A1 | 8/2019 | Gross et al. |
| 2019/0290691 A1 | 9/2019 | Jäckel et al. |
| 2019/0359678 A1 | 11/2019 | O'Donoghue et al. |
| 2020/0016203 A1 | 1/2020 | Pul et al. |
| 2020/0016204 A1 | 1/2020 | Pul et al. |
| 2020/0093861 A1 | 3/2020 | Klein et al. |
| 2020/0123270 A1 | 4/2020 | Doihara et al. |
| 2020/0188434 A1 | 6/2020 | Cordoba et al. |
| 2020/0199550 A1 | 6/2020 | Cordoba et al. |
| 2020/0261499 A1 | 8/2020 | Gross et al. |
| 2020/0316120 A1 | 10/2020 | Gross et al. |
| 2021/0206826 A1 | 7/2021 | Lim et al. |
| 2021/0230247 A1 | 7/2021 | Kamb et al. |
| 2021/0230251 A1 | 7/2021 | Gross et al. |
| 2022/0054551 A1 | 2/2022 | Wang et al. |
| 2022/0153807 A1 | 5/2022 | Kamb et al. |
| 2022/0162287 A1 | 5/2022 | Kamb et al. |

FOREIGN PATENT DOCUMENTS

| | | |
|---|---|---|
| EP | 3333193 A1 | 6/2018 |
| EP | 3632461 A1 | 4/2020 |
| EP | 3634990 A1 | 4/2020 |
| EP | 3688155 A1 | 8/2020 |
| WO | 9943817 A1 | 9/1999 |
| WO | 0129058 A1 | 4/2001 |
| WO | 0196584 A2 | 12/2001 |
| WO | 2012117002 A1 | 9/2012 |
| WO | 2014145252 A2 | 9/2014 |
| WO | 2015017214 A1 | 2/2015 |
| WO | 2015075468 A1 | 5/2015 |
| WO | 2015090230 A1 | 6/2015 |
| WO | 2015120096 A2 | 8/2015 |
| WO | 2015142314 A1 | 9/2015 |
| WO | 2016075612 A1 | 5/2016 |
| WO | 2016097231 A2 | 6/2016 |
| WO | 2016126608 A1 | 8/2016 |
| WO | 2016138034 A1 | 9/2016 |
| WO | 2016142532 A1 | 9/2016 |
| WO | 2016160622 A2 | 10/2016 |
| WO | 2017011804 A1 | 1/2017 |
| WO | 2017079705 A1 | 5/2017 |
| WO | 2017087723 A1 | 5/2017 |
| WO | 2017091905 A1 | 6/2017 |
| WO | 2017156484 A1 | 9/2017 |
| WO | 2018039247 A1 | 3/2018 |
| WO | 2018061014 A1 | 4/2018 |
| WO | 2018144535 A1 | 8/2018 |
| WO | 2018148454 A1 | 8/2018 |
| WO | 2018177967 A1 | 10/2018 |
| WO | 2018191748 A1 | 10/2018 |
| WO | 2018211244 A1 | 11/2018 |
| WO | 2018211245 A1 | 11/2018 |
| WO | 2018211246 A1 | 11/2018 |
| WO | 2019056099 A1 | 3/2019 |
| WO | 2019068007 A1 | 4/2019 |
| WO | 2019084055 A1 | 5/2019 |
| WO | 2019090215 A2 | 5/2019 |
| WO | 2019241549 A1 | 12/2019 |
| WO | 2020065406 A2 | 4/2020 |
| WO | 2020070290 A1 | 4/2020 |
| WO | 2020172177 A1 | 8/2020 |
| WO | 2020259550 A1 | 12/2020 |
| WO | 2021030149 A1 | 2/2021 |
| WO | 2021030153 A2 | 2/2021 |
| WO | 2021030182 A1 | 2/2021 |
| WO | 2021035093 A1 | 2/2021 |
| WO | 2021053587 A1 | 3/2021 |
| WO | 2021096868 A1 | 5/2021 |
| WO | 2021110647 A1 | 6/2021 |
| WO | 2021119489 A1 | 6/2021 |
| WO | 2021222576 A1 | 11/2021 |
| WO | 2021252635 A1 | 12/2021 |
| WO | 2022036065 A2 | 2/2022 |
| WO | 2022040454 A1 | 2/2022 |
| WO | 2022040470 A1 | 2/2022 |

OTHER PUBLICATIONS

International Search Report and Written Opinion received for PCT Application No. PCT/IB2019/001108, dated Jun. 26, 2020, 16 pages.

International Search Report and Written Opinion received for PCT Application No. PCT/IB2020/000710, dated Mar. 18, 2021, 18 pages.

International Search Report and Written Opinion received for PCT Application No. PCT/US2018/053583, dated Feb. 25, 2019, 12 pages.

International Search Report and Written Opinion received for PCT Application No. PCT/US2021/046774, dated Dec. 8, 2021, 10 pages.

International Search Report with Written Opinion corresponding to International Patent Application No. PCT/IL17/51102, dated Jan. 14, 2018, 8 pages.

NCBI Reference Sequence: NP_000738.2, retrieved from web Jun. 8, 2022, 4 pages.

NCBI Reference Sequence: NP_001278413.1, retrieved from web Jun. 8, 2022, 8 pages.

NCBI Reference Sequence: NP_001295327.1, retrieved from web Jun. 8, 2022, 7 pages.

NCBI Reference Sequence: NP_002199.3, retrieved from web Jun. 8, 2022, 5 pages.

NCBI Reference Sequence: NP_003684.2, retrieved from web Jun. 8, 2022, 4 pages.

NCBI Reference Sequence: NP_003830.1, retrieved from web Jun. 8, 2022, 3 pages.

NCBI Reference Sequence: NP_569057.2, retrieved from web Jun. 8, 2022, 4 pages.

Fe. 5, 2020 Pan-cancer Analysis of Whole Genomes, Nature, 578(7793):82-93 (50 pages).

Abecasis et al. (2010) "A Map of Human Genome Variation from Population-Scale Sequencing", Nature—1000 Genomes Project Consortium, 467(7319):1061-1073.

Abeyweera et al. (2011) "Inhibitory Signaling Blocks Activating Receptor Clustering and Induces Cytoskeletal Retraction in Natural Killer Cells", Journal of Cell Biology, 192(4):675-690.

Adusumilli et al. (Nov. 5, 2014) "Regional Delivery of Mesothelin-targeted CAR T Cells for Pleural Cancers: Safety and Preliminary Efficacy in Combination with Anti-PD-1 Agent", Journal of Clinical Oncology, 37(Suppl. 15):1 page.

Altschul et al. (Oct. 5, 1990) "Basic Local Alignment Search Tool", Journal of Molecular Biology, 215(3):403-410.

Altschul et al. (Sep. 1, 1997) "Gapped BLAST and PSI-BLAST: A New Generation of Protein Database Search Programs", Nucleic Acids Research, 25(17):3389-3402.

Auton (2015) "A global reference for human genetic variation", Nature, 526(7571):68-74.

Bacac et al. (2016) "A Novel Carcinoembryonic Antigen T-Cell Bispecific Antibody (CEA TCB) for the Treatment of Solid Tumors", Clinical Cancer Research, 22(13):3286-3297.

Badran et al. (Dec. 6, 2002) "Identification of Three NFAT Binding Motifs in the 5'-Upstream Region of the Human CD3γ Gene That

(56) References Cited

OTHER PUBLICATIONS

Differentially Bind NFATc1, NFATc2, and NF-κB p50", The Journal of Biological Chemistry, 277(49):47136-47148.
Barnstable et al. (1978) "Production of Monoclonal Antibodies to Group A Erythrocytes, HLA and Other Human Cell Surface Antigens—new Tools for Genetic Analysis", Cell, 14(1):9-20.
Barrett et al. (May 1999) "Evolution of Neoplastic Cell Lineages in Barrett Oesophagus", Nature Genetics, 22(1):106-109.
Basilion et al. (Aug. 1999) "Selective Killing of Cancer Cells Based on Loss of Heterozygosity and Normal Variation in the Human Genome: A New Paradigm for Anticancer Drug Therapy", Molecular Pharmacology, 56(2):359-369.
Bausch-Fluck et al. (Apr. 20, 2015) "A Mass Spectrometric-Derived Cell Surface Protein Atlas", PloS one, 10(4): e0121314. 22 pages.
Bayle et al. (Jan. 2006) "Rapamycin analogs with differential binding specificity permit orthogonal control of protein activity", Chemistry & Biology, 13(1):99-107.
Beatty et al. (Jul. 2018) "Activity of Mesothelin-Specific Chimeric Antigen Receptor T Cells Against Pancreatic Carcinoma Metastases in a Phase 1 Trial", Gastroenterology, 155(1):29-32.
Beaubier et al. (Mar. 22, 2019) "Clinical Validation of the Tempus xT Next-generation Targeted Oncology Sequencing Assay", Oncotarget, 10(24):2384-2396.
Bellon et al. (2002) "Mutational Analysis of Immunoreceptor Tyrosine-Based Inhibition Motifs of the Ig-Like Transcript 2 (CD85j) Leukocyte Receptor", Journal of Immunology, 168(7):3351-3359.
Bera et al. (Apr. 2000) "Mesothelin is not Required for Normal Mouse Development or Reproduction", Molecular and Cellular Biology, 20(8): 2902-2906.
Bergbold et al. (Dec. 2013) "Emerging Role of Rhomboid Family Proteins in Mammalian Biology and Disease", Biochimica et Biophysica Acta (BBA)—Biomembranes, 1828(12):2840-2848.
Berge et al. (Dec. 1998) "Selective Expansion of a Peripheral Blood Cd8+ Memory T Cell Subset Expressing Both Granzyme B and L-selectin During Primary Viral Infection in Renal Allograft Recipients", Transplantation Proceedings, 30(8):3975-3977.
Berger et al. (1982) "Monoclonal Antibody to HLA-A3", Hybridoma, 1(2):87-90.
Bern et al. (2019) "Inducible Down-regulation of MHC Class I Results in Natural Killer Cell Tolerance", Journal of Experimental Medicine, 216(1):99-116.
Beroukhim et al. (Feb. 18, 2010) "The Landscape of Somatic Copy-number Alteration Across Human Cancers", Nature, 463(7283):899-905 (17 pages).
Betts et al. (2004) "Detection of T-Cell Degranulation: CD107a and b", Methods in Cell Biology, 75:497-512.
Binstadt et al. (Dec. 1996) "Sequential Involvement of Lck and SHP-1 With MHC-Recognizing Receptors on NK ells Inhibits FcR-initiated Tyrosine Kinase Activation", Immunity, 5(6):629-638.
Bird et al. (1988) "Single-Chain Antigen-Binding Proteins", Science, 242(4877):423-426.
Blankenstein et al. (Apr. 2015) "Targeting Cancer-specific Mutations by T cell Receptor Gene Therapy", Current opinion in immunology, 33:112-119.
Boczkowski et al. (2000) "Induction of Tumor Immunity and Cytotoxic T Lymphocyte Responses using Dendritic Cells Transfected with Messenger RNA Amplified from Tumor Cells", Cancer Research, 60(4):1028-1034.
Bohmer et al. (Jun. 21, 2011) "Forward Light Scatter is a Simple Measure of T-cell Activation and Proliferation but is not Universally Suited for Doublet Discrimination", Cytometry Part A, 79(8):646-652.
Boland et al. (2010) "Microsatellite Instability in Colorectal Cancer", Gastroenterology, 138(6):2073-2087(30 pages).
Borges et al. (1997) "A Family of Human Lymphoid and Myeloid Lg-Like Receptors, Some of Which Bind to MHC Class I Molecules", Journal of Immunology, 159(11):5192-5196.
Brodsky et al. (Oct. 1979) "Monoclonal Antibodies for Analysis of the HLA System", Immunological Reviews, 47:3-61.

Bryceson et al. (2008) "Line of Attack: NK Cell Specificity and Integration of Signals", Current Opinion in Immunology, 20(3):344-352 (15 pages).
Burrell et al. (2013) "The Causes and Consequences of Genetic Heterogeneity in Cancer Evolution", Nature, 501(7467):338-345.
Caescu et al. (Oct. 2009) "Active site determinants of substrate recognition by the metalloproteinases TACE and ADAM10", Biochemical Journal, 424(1):79-88.
Carney et al. (Oct. 1986) "Monoclonal Antibody Specific for an Activated RAS Protein", Proceedings of the National Academy of Sciences of the United States of America, 83(19):7485-7489.
Carpelan-Holmström et al. (1995) "Preoperative Serum Levels of CEA and CA 242 in Colorectal Cancer", British Journal of Cancer, 71(4):868-872.
Cerami et al. (May 2012) The cBio Cancer Genomics Portal: An Open Platform for Exploring Multidimensional Cancer Genomics Data , Cancer Discovery, 2(5):401-404.
Chang et al. (Jan. 1, 1992) "Characterization of the Antigen (CAK1) Recognized by Monoclonal Antibody K1 Present on Ovarian Cancers and Normal Mesothelium", Cancer Research, 52:181-186.
Chao et al. (2006) "Isolating and Engineering Human Antibodies using Yeast Surface Display", Nature Protocols, 1(2):755-768.
Chau et al. (2004) "The Value of Routine Serum Carcino-embryonic Antigen Measurement and Computed Tomography in The Surveillance of Patients after Adjuvant Chemotherapy for Colorectal Cancer", Journal of Clinical Oncology, 22(8):1420-1429.
Chaurasiya et al. (Mar. 2017) "Viroimmunotherapy for Colorectal Cancer: Clinical Studies", Biomedicines, 5(1):11(14 pages).
Chess Andrew (2012) "Mechanisms and Consequences of Widespread Random Monoallelic Expression", Nature Reviews Genetics, 13(6):421-428.
Chicaybam et al. (2014) "Construction and validation of an activating and inhibitory chimeric antigen receptor (CAR) system", Cancer Research, Abstract 2797, 74(15):2 pages.
Chicaybam et al. (2015) "Construction and validation of an activating and inhibitory chimeric antigen receptor (CAR) system", Cancer Research, Abstract 3156, 75(15):2 pages.
Chowdhury et al. (Jan. 1998) "Isolation of a High-Affinity Stable Single-Chain Fv Specific for Mesothelin From DNA Immunized Mice by Phage Display and Construction of a Recombinant Immunotoxin With Anti-Tumor Activity", Proceedings of the National Academy of Sciences, 95(2):669-674.
Clarke et al. (1998) "Mice Transgenic for Human Carcinoembryonic Antigen as a Model for Immunotherapy", Cancer Research, 58(7):1469-1477.
Compagno et al. (Jun. 2009) "Mutations of Multiple Genes cause Deregulation of NF-kappaB in Diffuse Large B-cell Lymphoma", Nature, 459(7247):717-721 (13 pages).
Conaghan et al. (2008) "Targeted Killing of Colorectal Cancer Cell Lines by a Humanised LgG1 Monoclonal Antibody That Binds to Membrane-bound Carcinoembryonic Antigen", British Journal of Cancer, 98:1217-1225.
Cong et al. (Feb. 15, 2013) "Multiplex Genome Engineering Using CRISPR/Cas Systems", Science, 339(6121):819-823 (9 pages).
Cordoba et al. (May 23, 2013) "The large ectodomains of CD45 and CD148 regulate their segregation from and inhibition of ligated T-cell receptor", Blood, 121(21):4295-4302.
Da Cunha et al. (2009) "Bioinformatics construction of the human cell surfaceome", Proc Natl Acad Sci U S A., 106(39):16752-16757.
Database Genbank (Sep. 1, 2020) "C—X—C Motif Chemokine 16 Precursor [*Homo sapiens*]", NCBI Reference Sequence: NP_001094282. 1, 3 pages.
De Vree et al. (2014) "Targeted Sequencing by Proximity Ligation for Comprehensive Variant Detection and Local Haplotyping", Nature Biotechnology, 32(10):1019-1025 and 2 pages Online Methods.
Devilee et al. (2001) "Eversince Knudson", Trends in genetics, 17(10):569-573.
Ding et al. (Jul. 2018) "Preclinical Evaluation of Mesothelin-specific T Cell Receptor (TCR) Fusion Constructs (TRuC™ s) Utilizing the Signaling Power of the Complete TCR Complex: A New Opportunity for Solid Tumor Therapy", Cancer Research, Abstract 2307, 78(Suppl. 13):3589-3589.

(56) References Cited

OTHER PUBLICATIONS

Doench et al. (Jan. 18, 2016) "Optimized sgRNA Design to Maximize Activity and Minimize Off-target Effects of CRISPR-Cas9", Nature Biotechnology, 34:184-191.
Dotti et al. (Jan. 2014) "Design and Development of Therapies using Chimeric Antigen Receptor-Expressing T cells", Immunological Reviews, 257(1):107-126.
Durbin et al. (May 1994) "An Epitope on Carcinoembryonic Antigen Defined by the Clinically Relevant Antibody PR1A3", Proceedings of the National Academy of Sciences of the United States of America, 91(10):4313-4317.
Eades-Perner et al. (1994) "Mice Transgenic for the Human Carcinoembryonic Antigen Gene Maintain its Spatiotemporal Expression Pattern", Cancer Research, 54(15),4169-4176.
Ebsen et al. (Oct. 9, 2013) "Differential Surface Expression of ADAM10 and ADAM17 on Human T Lymphocytes and Tumor Cells", PloS one, e76853, 8(10):16 pages.
Ellis et al. (Mar. 2000) "Frequencies of HLA-A2 Alleles in Five U.S. Population Groups: Predominance of A*02011 and Identification of HLA-A*0231", Human Immunology, 61(3):334-340.
Engelhard et al. (1991) "Influenza A-specific, HLA-A2.1-Restricted Cytotoxic T Lymphocytes from HLA-A2.1 Transgenic Mice Recognize Fragments of the M1 Protein", Journal of Immunology, 146(4):1226-1232.
Eriksson et al. (Oct. 4, 1999) "Inhibitory Receptors Alter Natural Killer Cell Interactions with Target Cells Yet Allow Simultaneous Killing of Susceptible Targets", The Journal of Experimental Medicine, 190(7):1005-1012.
Fedorov et al. (Dec. 11, 2013) "PD-1- and CTLA-4-Based Inhibitory Chimeric Antigen Receptors (iCARs) Divert Off-Target Immunotherapy Responses", Science Translational Medicine, 215ra172, 5(215):25 pages.
Feenstra et al. (1999) "HLA Class I Expression and Chromosomal Deletions at 6p and 15q in Head and Neck Squamous Cell Carcinomas", Tissue antigens, 54(3):235-245.
Feng et al. (May 2009) "A Novel Human Monoclonal Antibody that Binds with High Affinity to Mesothelin-Expressing Cells and Kills them by ADCC", Molecular Cancer Therapeutics, 8(5):1113-1118.
Finney et al. (1998) "Chimeric Receptors Providing Both Primary and Costimulatory Signaling in T Cells from a Single Gene Product", Journal of Immunology, 161(6):2791-2797.
Foo et al. (Aug. 21, 2014) "Evolution of Acquired Resistance to Anti-cancer Therapy", Journal of Theoretical Biology, 355:10-20.
Ford et al. (Mar. 2020) "A Profile on the FoundationFocus CDxBRCA Tests", Expert Review of Molecular Diagnostics, 20(3):285-292.
Fu et al. (2013) "High-frequency off-target Mutagenesis induced by CRISPR-Cas Nucleases in Human Cells", Nature Biotechnology, 31(9):822-826(13 pages).
Fujiwara et al. (May 9, 2020) "Hinge and Transmembrane Domains of Chimeric Antigen Receptor Regulate Receptor Expression and Signaling Threshold", Cells, 17 pages.
Gao et al. (2013) "Integrative Analysis of Complex Cancer Genomics and Clinical Profiles Using the cBioPortal", Sci Signal., 6(269):1-34.
Garland et al. (Jul. 30, 1999) "The Use of Teflon Cell Culture Bags to Expand Functionally Active CD8+ Cytotoxic T Lymphocytes", Journal of Immunological Methods, 227(1-2):53-63.
Genbank (Jul. 3, 2022) "B2M beta-2-microglobulin [ *Homo sapiens* (human) ]", Gene ID 567, 12 pages.
Genbank (Jul. 3, 2022) "HLA-A major histocompatibility complex, class I, A [ *Homo sapiens* (human) ]", Gene ID: 3105, 15 pages.
Genbank (Jul. 3, 2022) "HLA-B major histocompatibility complex, class I, B [ *Homo sapiens* (human) ]", Gene ID: 3106, 14 pages.
Genbank (Jul. 3, 2022) "HLA-C Major Histocompatibility Complex, Class I, C [ *Homo sapiens* (human) ]", Gene ID: 3107, 13 pages.
Genbank (Apr. 6, 2020) "*Homo sapiens* chromosome 15, GRCh38.p14 Primary Assembly", Accession No. NC_000015.10, 2 pages.
Genbank (May 19, 2014) "*Homo sapiens* HLA-A gene for MHC class I antigen, isolate DKMS-LSL-A-160, allele HLA-A*02", Accession No. LK021978.1, 3 pages.
Genbank (May 22, 2022) "Intercellular Adhesion Molecule 1 Precursor [*Homo sapiens*]", Accession No. NP_000192.2, 4 pages.
Genbank (Jun. 2, 2022) "Leucine-rich Repeat Neuronal Protein 4 Precursor [*Homo sapiens*]", Accession No. NP_689824.2, 4 pages.
Genbank (Apr. 17, 2022) "Uroplakin-3b Isoform a Precursor [*Homo sapiens*]", Accession No. NP_085047.1, 2 pages.
Genbank (Apr. 17, 2022) "Uroplakin-3b Isoform b Precursor [*Homo sapiens*]", Accession No. NP_872625.1, 2 pages.
Genbank (Apr. 17, 2022) "Uroplakin-3b Isoform c Precursor [*Homo sapiens*]", Accession No. NP_872624.1, 2 pages.
Genbank (Feb. 19, 2021) "Uroplakin-3b Isoform d Precursor [*Homo sapiens*]", Accession No. NP_001334613.1, 2 pages.
Gerlinger et al. (2012) "Intratumor Heterogeneity and Branched Evolution Revealed by Multiregion Sequencing", New England Journal of Medicine, 366(10):883-892.
Gianfrancesco et al. (2012) "A nonsynonymous TNFRSF11A Variation Increases NFKB Activity and the Severity of Paget's Disease", Journal of Bone and Mineral Research, 27(2):443-452.
Gill et al. (Jan. 2015) "Going Viral: Chimeric Antigen Receptor T-Cell Therapy for Hematological Malignancies", Immunological Reviews, 263(1):68-89.
Gold et al. (Sep. 1, 1965) "Specific Carcinoembryonic Antigens of the Human Digestive System", Journal of Experimental Medicine, 122(3):467-481.
Golfier et al. (Jun. 2014) "Anetumab Ravtansine: A Novel Mesothelin-targeting Antibody-drug Conjugate Cures Tumors with Heterogeneous Target Expression Favored by Bystander Effect", Molecular Cancer Therapeutics, 13(6):1537-1548.
Gordon et al. (Jun. 22, 2015) "Mechanical Allostery: Evidence for a Force Requirement in the Proteolytic Activation of Notch", Developmental Cell, 33(6):729-736. 20 pages.
Graef et al. (1997) "Proximity and Orientation Underlie Signaling by the Non-Receptor Tyrosine Kinase ZAP70", The EMBO, 16(18):5618-5628.
Gragert et al. (Oct. 2013) "Six-Locus High Resolution HLA Haplotype Frequencies Derived from Mixed-Resolution DNA Typing for the Entire US Donor Registry", Human Immunology, 74(10):1313-1320.
Gross et al. (Dec. 1989) "Expression of Immunoglobulin-T-Cell Receptor Chimeric Molecules as Functional Receptors with Antibody-Type Specificity", Proc. Natl. Acad. Sci. USA, 86(24):10024-10028.
Gross et al. (2016) "Therapeutic Potential of T Cell Chimeric Antigen Receptors (CARs) in Cancer Treatment: Counteracting Off-Tumor Toxicities for Safe CAR T Cell Therapy", Annual Review of Pharmacology and Toxicology, 56:59-83.
GTEx Consortium (2015) "The Genotype-Tissue Expression (GTEx) Pilot Analysis Multitissue Gene Regulation in Humans", Science, 348(6235):648-660. 33 pages.
Gustafson et al. (2017) "Immune Checkpoint Function of CD85j in CD8 T Cell Differentiation and Aging", Frontiers in Immunology, 8(692)1-12.
Haanen et al. (Nov. 1, 1999) "Selective Expansion of Cross-Reactive Cd8+ Memory T Cells by Viral Variants", Journal of Experimental Medicine, 190(9):1319-1328.
Haapasalo et al. (2011) "The Many Substrates of Presenilin/γ-Secretase", Journal of Alzheimer's disease, 25(1):3-28.
Hamburger et al. (Dec. 2020) "Engineered T cells directed at tumors with defined allelic loss", Molecular Immunology, 128:298-310.
Hanes et al. (May 1997) "In Vitro Selection and Evolution of Functional Proteins by Using Ribosome Display", Proceedings of the National Academy of Sciences, 94(10):4937-4942.
Hassan et al. (Dec. 2016) "Mesothelin Immunotherapy for Cancer: Ready for Prime Time?", Journal of Clinical Oncology, 34(34):4171-4179.
Hassan et al. (Nov. 1, 2014) "Phase 1 Study of the Antimesothelin Immunotoxin SS1P in Combination with Pemetrexed and Cisplatin for Front-Line Therapy of Pleural Mesothelioma and Correlation of Tumor Response With Serum Mesothelin, Megakaryocyte Potentiating Factor, and Cancer Antigen", Cancer, 120(21):3311-3319.

(56) References Cited

OTHER PUBLICATIONS

Hassan et al. (Sep. 4, 2007) "Phase I Study of SS1P, a Recombinant Anti-Mesothelin Immunotoxin Given as a Bolus I.V. Infusion to Patients with Mesothelin-Expressing Mesothelioma, Ovarian, and Pancreatic Cancers", Clinical Cancer Research, 13(17):5144-5149.
Heemskerk et al. (2013) "The Cancer Antigenome", The EMBO journal, 32(2):194-203.
Hemming et al. (Dec. 29, 2009) "Identification of β-Secretase (BACE1) Substrates Using Quantitative Proteomics", PLoS One, 4(12):e8477. pp. 1-14.
Hilton et al. (Apr. 2013) "Direct Binding to Antigen-Coated Beads Refines the Specificity and Cross-Reactivity of Four Monoclonal Antibodies That Recognize Polymorphic Epitopes of HLA Class I Molecules", Tissue Antigens, 81(4):212-220.
Hofmann et al. (1993) "TMbase—A Database of Membrane Spanning Proteins Segments", Journal of Biological Chemistry, 347:166(2 pages).
Houston et al. (Aug. 1988) "Protein Engineering of Antibody Binding Sites: Recovery of Specific Activity in an Anti-digoxin Single-chain Fv Analogue Produced in *Escherichia coli*", Proceedings of the National Academy of Sciences of the United States of America, 85(16):5879-5883.
Hsu et al. (2007) "Cytokine-Independent Growth and Clonal Expansion of a Primary Human CD8+ T-Cell Clone Following Retroviral Transduction with The IL-15 Gene", Blood, 109(12):5168-5177(12 pages).
Huse et al. (2013) "Building Tolerance by Dismantling Synapses: Inhibitory Receptor Signaling in Natural Killer Cells", Immunological reviews, 251(1):143-153.
Huston et al. (Aug. 1, 1988) "Protein Engineering of Antibody Binding Sites: Recovery of Specific Activity in an Anti-Digoxin Single-Chain Fv Analogue Produced in *Escherichia coli*.", Proceedings of the National Academy of Sciences of the United States of America, 85(16):5879-5883.
Hwang et al. (Mar. 17, 2021) "Targeting Loss of Heterozygosity for Cancer-specific Immunotherapy", Proceedings of the National Academy of Sciences of the United States of America, e2022410118, 118(12):1-10 pages.
Irles et al. (2003) "CD45 ectodomain Controls Interaction with GEMs and Lck Activity for Optimal TCR Signaling", Nature Immunology, 4:189-197.
James et al. (Apr. 15, 2010) "Mathematical Modeling of Chimeric TCR Triggering Predicts the Magnitude of Target Lysis and Its Impairment by TCR Downmodulation", The Journal of Immunology, 184(8):4284-4294.
Ji et al. (2010) "A Modified Toxicity Probability Interval Method for Dose-finding Trials", Clinical Trials, 7(6):653-663(21 pages).
Ji et al. (2013) "Modified Toxicity Probability Interval Design: A Safer and More Reliable Method Than the 3+3 Design for Practical Phase I Trials", Journal of Clinical Oncology, 31(14):1785-1791(12 pages).
Jimenez et al. (1999) "Chromosome Loss is the Most Frequent Mechanism Contributing to HLA Haplotype Loss in Human Tumors", International Journal of Cancer, 83(1):91-97.
Kammerer et al. (2010) "Coevolution of Activating and Inhibitory Receptors Within Mammalian Carcinoembryonic Antigen Families", BMC Biology, 8(12):1-21.
Karlin et al. (Jun. 1993) "Applications and Statistics for Multiple High-Scoring Segments in Molecular Sequences", Proceedings of the National Academy of Sciences, 90(12):5873-5877.
Karlin et al. (Mar. 1990) "Methods for Assessing the Statistical Significance of Molecular Sequence Features by Using General Scoring Schemes", Proceedings of the National Academy of Sciences of the United States of America, 87(6):2264-2268.
Katz et al. (May 2016) "Regional CAR-T Cell Infusions for Peritoneal Carcinomatosis are Superior to Systemic Delivery", Cancer Gene Therapy, 23(5):142-148(14 pages).
Kersh et al. (1996) "Structural Basis for T Cell Recognition of Altered Peptide Ligands: A Single T Cell Receptor Can Productively Recognize a Large Continuum of Related Ligands", Journal of Experimental Medicine, 184(4):1259-1268.
Klampatsa et al. (Apr. 2021) "Mesothelin-targeted CAR-T Cell Therapy for Solid Tumors", Expert Opinion on Biological Therapy, 21(4):473-486.
Klebanoff et al. (2016) "Prospects for Gene-engineered T Cell Immunotherapy for Solid Cancers", Nature medicine, 22(1):26-36 (25 pages).
Kloor et al. (2010) "Immune Evasion of Microsatellite Unstable Colorectal Cancers", International Journal of Cancer, 127:1001-1010.
Kloss et al. (2013) "Combinatorial Antigen Recognition with Balanced Signaling Promotes Selective Tumor Eradication by Engineered T Cells", Nature biotechnology, 31(1):71-75 (15 pages).
Knudson et al. (1971) "Mutation and cancer: statistical study of retinoblastoma", Proceedings of the National Academy of Sciences, 68(4):820-823.
Krogh et al. (Jan. 19, 2001) "Predicting Transmembrane Protein Topology with a Hidden Markov Model: Application to Complete Genomes", Journal of Molecular Biology, 305(3):567-580.
Lanitis et al. (2013) "Chimeric Antigen Receptor T Cells with Dissociated Signaling Domains Exhibit Focused Anti-Tumor Activity with Reduced Potential for Toxicity In Vivo", Cancer immunology research, 1(1):43-53. 20 pages.
Lawrence et al. (2014) "Discovery and Saturation Analysis of Cancer Genes Across 21 Tumor Types", Nature, 505(7484): 495-501. 22 pages.
Lawrence et al. (2013) "Mutational heterogeneity in cancer and the search for new cancer-associated genes", Nature, 499(7457):214-218. 12 pages.
Lech et al. (Feb. 7, 2016) "Colorectal Cancer Tumour Markers and Biomarkers: Recent Therapeutic Advances", World Journal of Gastroenterology, 22(5):1745-1755.
Lee et al. (2019) "AST CT Consensus Grading for Cytokine Release Syndrome and Neurologic Toxicity Associated with Immune Effector Cells", Biology of Blood and Marrow Transplantation, 25(4):625-638.
Lee et al. (Mar. 2003) "Distribution Analysis of Nonsynonymous Polymorphisms within the G-Protein-Coupled Receptor Gene Family", Genomics, 81(3):245-248.
Lek et al. (2016) "Analysis of Protein-Coding Genetic Variation in 60,706 Humans", Nature, 536(7616):285-291(33 pages).
Lengauer et al. (1998) "Genetic Instabilities in Human Cancers", Nature, 396(6712):643-649.
Leung et al. (2019) "Sensitive and adaptable pharmacological control of CAR T cells through extracellular receptor dimerization", JCI Insight, e124430, 4(11):19 pages.
Li et al. (2014) "A Preliminary Study of the Relationship Between Breast Cancer Metastasis and Loss of Heterozygosity by Using Exome Sequencing", Scientific Reports, 4:5460(1-6).
Li et al. (Mar. 2020) "LILRB4 ITIMs mediate the T cell suppression and infiltration of acute myeloid leukemia cells", Cellular & Molecular Immunology, 17(3):272-282.
Liberles et al. (Jul. 1997) "Inducible Gene Expression and Protein Translocation Using Nontoxic Ligands Identified by a Mammalian Three-hybrid Screen", Proceedings of the National Academy of Sciences, 94(15):7825-7830.
Lindblad-Toh et al. (2000) "Loss-of-heterozygosity Analysis of Small-cell Lung Carcinomas Using Single-nucleotide Polymorphism Arrays", Nature Biotechnology, 18(9):1001-1005.
Lo et al. (2008) "Comprehensive Analysis of Loss of Heterozygosity Events in Glioblastoma using the 100K SNP Mapping Arrays and Comparison with Copy Number Abnormalities Defined by BAC Array Comparative Genomic Hybridization", Genes Chromosomes Cancer, 47(3):221-237.
Long et al. (2013) "Controlling NK Cell Responses: Integration of Signals for Activation and Inhibition", Annual Review of Immunology, 31:227-258(36 pages).
Lopez et al. (Mar. 5, 2020) "Interplay Between Whole-genome Doubling and the Accumulation of Deleterious Alterations in Cancer Evolution", Nature Genetics, 52(3):283-293.

(56) References Cited

OTHER PUBLICATIONS

Luke et al. (Feb. 2021) "Phase I Study of ABBV-428, a Mesothelin-CD40 Bispecific, in Patients with Advanced Solid Tumors", Journal for ImmunoTherapy of Cancer, e002015, 9(2):10 pages.

MacDonald et al. (2016) "Alloantigen-specific Regulatory T Cells Generated with a Chimeric Antigen Receptor", Journal of Clinical Investigation, 126(4):1413-1424.

Maleno et al. (2004) "Distribution of HLA Class I Altered Phenotypes in Colorectal Carcinomas: High Frequency of HLA Haplotype Loss Associated with Loss of Heterozygosity in Chromosome Region 6p21", Immunogenetics, 56(4):244-253.

Maleno et al. (2010) "Frequent Loss of Heterozygosity in the B2-Microglobulin Region of Chromosome 15 in Primary Human Tumors", Immunogenetics, 63(2):65-71.

Maleno et al. (2006) "LOH at 6p21.3 Region and HLA Class Altered Phenotypes in Bladder Carcinomas", Immunogenetics, 58(7):503-510.

Maleno et al. (2002) "Multiple Mechanisms Generate HLA Class I Altered Phenotypes in Laryngeal Carcinomas: High Frequency of HLA Haplotype Loss Associated with Loss of Heterozygosity in Chromosome Region 6p21", Cancer Immunology, Immunotherapy, 51(7):389-396.

Marguerat et al. (2012) "Quantitative Analysis of Fission Yeast Transcriptomes and Proteomes in Proliferating and Quiescent Cells", Cell, 151(3):671-683.

Marinov et al. (2014) "From Single-Cell to Cell-Pool Transcriptomes: Stochasticity in Gene Expression and RNA Splicing", Genome Research, 24(3):496-510.

Markowitz et al. (1995) "Inactivation of the Type II TGF-Beta Receptor in Colon Cancer Cells with Microsatellite Instability", Science, 268(5215):1336-1338.

Mastrogiovanni et al. (Oct. 21, 2020) "Coordinating Cytoskeleton and Molecular Traffic in T Cell Migration, Activation, and Effector Functions", Frontiers in Cell and Developmental Biology, 591348, 8:30 pages.

Maude et al. (2018) "Tisagenlecleucel in Children and Young Adults with B-Cell Lymphoblastic Leukemia", The New England Journal of Medicine, 378(5):439-448.

Maus et al. (2016) "An MHC-Restricted Antibody-Based Chimeric Antigen Receptor Requires TCR-Like Affinity to Maintain Antigen Specificity", Molecular Therapy—Oncolytics, 3(16023):1-9.

McEvoy et al. (2002) "Frequency and Genetic Basis of MHC, beta-2-microglobulin and MEMO-1 Loss of Heterozygosity in Sporadic Breast Cancer", Tissue Antigens, 60(3):235-243.

McEwan et al. (2020) "Allogeneic CAR-T Cell Products Containing 10 Gene Edits using CRISPR/Cas9 can Retain Full Functionality In Vivo and In Vitro American Association for Cancer Research", Philadelphia, 1 page.

McGranahan et al. (2017) "Allele-Specific HLA Loss and Immune Escape in Lung Cancer Evolution", Cell, 171:1259-1271.

McGranahan et al. (2012) "Cancer Chromosomal Instability: Therapeutic and Diagnostic Challenges", EMBO reports, 13(6):528-538.

Medintz et al. (2000) "Loss of Heterozygosity Assay for Molecular Detection of Cancer Using Energy-transfer Primers and Capillary Array Electrophoresis", Genome Research, 10(8):1211-1218.

Mingoia et al. (2020) "Induction of Therapeutic Levels of HBF in Genome-Edited Primary Beta(0) 39-Thalassaemia Haematopoietic Stem and Progenitor Cells", British Journal of Haematology, 192:395-404.

Mizuguchi et al. (2004) "Heterozygous TGFBR2 Mutations in Marfan Syndrome", Nature Genetics, 36(8):855-860.

Montesion et al. (Feb. 2021) "Somatic HLA Class I Loss is a Widespread Mechanism of Immune Evasion Which Refines the use of Tumor Mutational Burden as a Biomarker of Checkpoint Inhibitor Response", Cancer Discovery, 11(2):282-292.

Morgan et al. (2013) "Cancer Regression and Neurological Toxicity Following Anti-MAGE-A3 TCR Gene Therapy", Journal of Immunotherapy, 36(2):133-151(38 pages).

Morgan et al. (Apr. 2010) "Case Report of a Serious Adverse Event Following the Administration of T Cells Transduced with a Chimeric Antigen Receptor Recognizing ERBB2", Molecular Therapy, 18(4):843-851.

Mori et al. (2001) "Instabilotyping: Comprehensive Identification of Frameshift Mutations Caused by Coding Region Microsatellite Instability", Cancer Research, 61:6046-6049.

Morsut et al. (Feb. 11, 2016) "Engineering Customized Cell Sensing and Response Behaviors using Synthetic Notch Receptors", Cell, 164(4):780-791.

Dec. 24, 2014 A Study of R06958688 in Participants with Locally Advanced and/or Metastatic Carcinoembryonic Antigen Positive Solid Tumors, retrieved online Mar. 31, 2022, from clinicaltrials. gov/ct2/show/NCT02324257, 12 pages.

Jan. 8, 2016 A Study of the Safety, Pharmacokinetics, and Therapeutic Activity of R06958688 in Combination with Atezolizumab in Participants with Locally Advanced and/or Metastatic Carcinoembryonic Antigen (CEA)-Positive Solid Tumors, retrieved online Mar. 31, 2022, from clinicaltri als. gov/ct2/show/NCT02650713, 9 pages.

Aug. 1, 2016 CAR-T Hepatic Artery Infusions or Pancreatic Venous Infusions for CEA-Expressing Liver Metastases or Pancreas Cancer (HITM-SURE), retrieved online Mar. 31, 2022, from clinicaltrials. gov/ct2/show/NCT02850536, 8 pages.

Sep. 25, 2018 CAR-T Intraperitoneal Infusions for CEA-Expressing Adenocarcinoma Peritoneal Metastases or Malignant Ascites (IPC), retrieved online Mar. 31, 2022, from clinicaltrials. gov/ct2/show/NCT03682744, 8 pages.

Jan. 28, 2019 Phase 1b Study of CAR2Anti-CEA CAR-T Cell Hepatic Infusions for Pancreatic Carcinoma Patients With CEA+ Liver Metastases (AntiCEA_CART), retrieved online Mar. 31, 2022, from clinicaltrials.gov/ct2/show/NCT03818165, 9 pages.

Jul. 30, 2019 Study of Anti-CEA CAR-T +Chemotherapy VS Chemotherapy Alone in Patients With CEA+Pancreatic Cancer & Liver Metastases, retrieved online Mar. 31, 2022, from clinicaltrials. gov/ct2/show/NCT04037241, 14 pages.

Apr. 16, 2020 Safety and Efficacy of CEA-Targeted CAR-T Therapy for Relapsed/Refractory CEA+ Cancer, retrieved online Mar. 31, 2022, from clinicaltrials.gov/ct2/show/NCT04348643, 8 pages.

Neelapu et al. (2017) "Axicabtagene Ciloleucel CART-Cell Therapy in Refractory Large B-Cell Lymphoma", The New England Journal of Medicine, 377(26):2531-2544.

Newrzela et al. (2008) "Resistance of Mature T Cells to Oncogene Transformation", Blood, 112(6):2278-2286.

Newrzela et al. (2011) "Retroviral Insertional Mutagenesis Can Contribute to Immortalization of Mature T Lymphocytes", Molecular Medicine, 17(11-12):1223-1232.

Ng et al. (2003) "SIFT: Predicting Amino Acid Changes that Affect Protein Function", Nucleic Acids Research, 31(13):3812-3814.

Nirschl et al. (Sep. 15, 2013) "Molecular Pathways: Coexpression of Immune Checkpoint Molecules: Signaling Pathways and Implications for Cancer Immunotherapy", Clinical Cancer Research, 19(18):4917-4924.

Oberst et al. (Nov./Dec. 2014) "CEA/CD3 Bispecific Antibody MEDI-565/AMG 211 Activation of T Cells and Subsequent Killing of Human Tumors is Independent of Mutations Commonly Found in Colorectal Adenocarcinomas", MAbs, 6(6):1571-1584.

O'Hara et al. (Aug. 2017) "Overcoming Barriers of Car T-cell Therapy in Patients with Mesothelin-expressing Cancers", Immunotherapy, 9(9):767-780.

Ohgaki et al. (Oct. 1, 2004) "Genetic Pathways to Glioblastoma A Population-Based Study", Cancer Research, 64(19):6892-6899.

O'Keefe et al. (2010) "Copy Neutral Loss of Heterozygosity: A Novel Chromosomal Lesion in Myeloid Malignancies", Blood, 115(14):2731-2739.

Overwijk et al. (2013) "Mining the Mutanome: Developing Highly Personalized Immunotherapies Based on Mutational Analysis of Tumors", Journal for ImmunoTherapy of Cancer, 1:11 (1-4).

Parham et al. (Nov. 23, 1978) "Monoclonal Antibody to a Human Histocompatibility Alloantigen, HLA-A2", Nature, 276(5686):397-399.

Parkhurst et al. (2009) "Characterization of Genetically Modified T-cell Receptors That Recognize the CEA:691-699 Peptide in the

(56) References Cited

OTHER PUBLICATIONS

Context of HLA-A2.1 on Human Colorectal Cancer Cells", Clinical Cancer Research, 15(1):169-180 (23 pages).

Parkhurst et al. (2011) "T Cells Targeting Carcinoembryonic Antigen can Mediate Regression of Metastatic Colorectal Cancer but Induce Severe Transient Colitis", Molecular Therapy, 19(3):620-626.

Parsons et al. (1995) "Microsatellite Instability and Mutations of the Transforming Growth Factor Beta Type II Receptor Gene in Colorectal Cancer", Cancer Research, 55:5548-5550.

Patel et al. (2014) "Cancer CARtography: Charting Out a New Approach to Cancer Immunotherapy", Immunotherapy, 6(6):675-678 (6 pages).

Patton et al. (2015) "Evaluation of the Efficiency of Human Immune System Reconstitution in NSG Mice and NSG Mice Containing a Human HLA.A2 Transgene using Hematopoietic Stem Cells Purified from Different Sources", Journal of Immunological Methods, 422:13-21.

Pennisi Elizabeth (Aug. 23, 2013) "The CRISPR Craze", Science, 341(6148):833-836.

Priestley et al. (2019) "Pan-cancer Whole-genome Analyses of Metastatic Solid Tumours", Nature, 575(7781):210-216(24 pages).

Qi et al. (2014) "Diversity and Clonal Selection in the Human T-Cell Repertoire", Proceedings of the National Academy of Sciences of the United States of America, 111(36):13139-13144.

Qin et al. (2004) "Integrin Bi-directional Signaling: A Molecular View", PLOS Biology, 2:726-729.

Raje et al. (2019) "Anti-BCMA CART-Cell Therapy bb2121 in Relapsed or Refractory Multiple Myeloma", The New England Journal of Medicine, 380(18):1726-1737 (21 pages).

Ramos et al. (Jun. 2015) "Molecular Biology Techniques for Loss of Heterozygosity Detection: The Glioma Example", Jornal Brasileiro de Patologia e Medicina Laboratorial, 51(3):189-196.

Ran et al. (Sep. 12, 2013) "Double Nicking by RNA-Guided CRISPR Cas9 for Enhanced Genome Editing Specificity", Cell, 154(6):1380-1389.

Rana et al. (2001) "Genetic Variations and Polymorphisms of G Protein-coupled Receptors: Functional and Therapeutic Implications", Annual Review of Pharmacology and Toxicology, 41(1):593-624.

Rawson Robert B. (2013) "The Site-2 Protease", Biochimica et Biophysica Acta (BBA)—Biomembranes, 1828(12):2801-2807.

Ren et al. (May 1, 2017) "Multiplex Genome Editing to Generate Universal CAR T Cells Resistant to PD1 Inhibition", Clinical Cancer Research, 23(9):2255-2266 (21 pages).

Restifo et al. (2012) "Adoptive Immunotherapy for Cancer: Harnessing the T Cell Response", Nature Reviews Immunology, 12(4):269-281(30 pages).

Roex et al. (Feb. 24, 2020) "Chimeric Antigen Receptor-T-Cell Therapy for B-Cell Hematological Malignancies: An Update of the Pivotal Clinical Trial Data", Pharmaceutics, 194, 12(2):15 pages.

Rosenberg et al. (2015) "Adoptive Cell Transfer as Personalized Immunotherapy for Human Cancer", Science, 348(6230):62-68.

Rosenberg Steven A. (2014) "Finding Suitable Targets is the Major Obstacle to Cancer Gene Therapy", Cancer Gene Therapy, 21:45-47.

Roybal et al. (Feb. 11, 2016) "Precision Tumor Recognition by T Cells with Combinatorial Antigen-Sensing Circuits", Cell, 164:770-779.

Sathirapongsasuti et al. (2011) "Exome Sequencing-based Copy-number Variation and Loss of Heterozygosity Detection: Exomecnv", Bioinformatics, 27(19):2648-2654.

Savage Peter A. (2014) "Tumor Antienicity Revealed", Trends in immunology, 35(2):47-48(3 pages).

Savova et al. (2016) "Genes with Monoallelic Expression Contribute Disproportionately to Genetic Diversity in Humans", Nature Genetics, 48(3):231-237(25 pages).

Sayós et al. (2004) "Recruitment of C-Terminal SRC Kinase by the Leukocyte Inhibitory Receptor CD85j", Biochemical and Biophysical Research Communications, 324(2):640-647.

Schumacher et al. (Apr. 3, 2015) "Neoantigens in Cancer Immunotherapy", Science, 348(6230):69-74.

Schuster et al. (2017) "The Immunopeptidomic Landscape of Ovarian Carcinomas", Proceedings of the National Academy of Sciences of the United States of America, 114(46):E9942-E9951.

Schwanhausser et al. (May 19, 2011) "Global Quantification of Mammalian Gene Expression Control", Nature, 473(7347):337-342.

Sela-Culang (Apr. 2015) "Antibody Specific Epitope Predictionemergence of a New Paradigm", Current opinion in virology, 11:98-102.

Sela-Culang et al. (Apr. 15, 2015) "PEASE: predicting B-cell epitopes utilizing antibody sequence", Bioinformatics, 31(8):1313-1315.

Sergeeva et al. (2008) "Direct Visualization of PR1/HLA-A2 on the Membrane of HLAA2+CD13+CD33+ Myeloid Leukemia Blasts by a Novel Monoclonal Antibody", Blood, 112(11):2545(2 pages).

Shultz et al. (2010) "Generation of Functional Human T-cell Subsets with HLA-restricted Immune Responses in HLA Class I Expressing NOD/SCID/IL2r Gamma(null) Humanized Mice", Proceedings of the National Academy of Sciences of the United States of America, 107(29):13022-13027.

Skora et al. (Aug. 11, 2015) "Generation of MANAbodies Specific to HLA-Restricted Epitopes Encoded by Somatically Mutated Genes", Proceedings of the National Academy of Sciences, 112(32):9967-9972.

Smith et al. (2020) "Genome-Wide Analysis of Off-Target CRISPR/Cas9 Activity in Single-Cell-Derived Human Hematopoietic Stem and Progenitor Cell Clones", Genes, 11:1-16.

Smith et al. (Aug. 31, 1999) "Standardisation of a Procedure for Quantifying Surface Antigens by Indirect Immunofluorescence", Journal of Immunological Methods, 228(1-2):29-36.

Spierings E. (Aug. 31, 2008) "Minor Histocompatibility Antigens: Targets for Tumour Therapy and Transplant Tolerance", International Journal of Immunogenetics, 35(4-5):363-366.

Stark et al. (Sep. 1, 1991) "Antibodies that are Specific for a Single Amino Acid Interchange in a Protein Epitope Use Structurally Distinct Variable Regions", The Journal of Experimental Medicine, 174(3):613-624.

Stark, et al. (Mar. 15, 2007) "Genome-Wide Loss of Heterozygosity and Copy Number Analysis in Melanoma using High-Density Single-Nucleotide Polymorphism Arrays", Cancer Research, 67(6):2632-2642.

Stewart et al. (1999) "Humanisation and Characterisation of PR1A3, A Monoclonal Antibody Specific for Cell-Bound Carcinoembryonic Antigen", Cancer Immunology, Immunotherapy, 47:299-306.

Strowig et al. (2009) "Priming of Protective T Cell Responses Against Virus-induced Tumors in Mice with Human Immune System Components", Journal of Experimental Medicine, 206(6):1423-1434.

Sun et al. (Jun. 11, 2014) "Construction and Evaluation of a Novel Humanized HER2-Specific Chimeric Receptor", Breast Cancer Research, R61, 16(3):10 pages.

Ta et al. (2010) "Structure-Based Development of a Receptor Activator of Nuclear Factor-Kappab Ligand (RAN KL) Inhibitor Peptide and molecular basis for osteopetrosis,", Proceedings of the National Academy of Sciences of the United States of America, 107:20281-20286.

Tabernero et al. (May 20, 2017) "Phase La and Lb Studies of the Novel Carcinoembryonic Antigen (CEA) T-Cell Bispecific (CEA CD3 TCB) Antibody as a Single Agent and in Combination with Atezolizumab: Preliminary Efficacy and Safety in Patients with Metastatic Colorectal Cancer (mCRC)", Journal of Clinical Oncology, 35(15):3002-3002(2 pages).

Tait et al. (Mar. 31, 2001) "Clinical Relevance of the Minor Histocompatibility Antigen HA-1 in Allogeneic Bone Marrow Transplantation Between HLA Identical Siblings", Transplantation Proceedings, 33(1-2):1760-1761.

Tanyi et al. (Apr. 2017) "Possible Compartmental Cytokine Release Syndrome in a Patient with Recurrent Ovarian Cancer After Treatment with Mesothelin-targeted CAR-T Cells", Journal of Immunotherapy, 40(3):104-107.

(56) References Cited

OTHER PUBLICATIONS

Teo et al. (Nov. 1, 2012) "Statistical Challenges Associated with Detecting Copy Number Variations with Next-Generation Sequencing", Bioinformatics, 28(21):2711-2718.
Teras et al. (2016) "2016 US Lymphoid Malignancy Statistics by World Health Organization Subtypes", CA: A Cancer Journal for Clinicians, 66(6):443-459.
Thul et al. (May 26, 2017) "A Subcellular Map of the Human Proteome", Science, eaal3321, 356(6340):14 pages.
Tóth-Petroczy et al. (2011) "Slow Protein Evolutionary Rates are Dictated by Surface-core Association", Proceedings of the National Academy of Sciences of the United States of America, 108(27):11151-11156.
Treanor et al. (Jul. 3, 2006) "Microclusters of Inhibitory Killer Immunoglobulin-like Receptor Signaling at Natural Killer Cell Immunological Synapses", The Journal of cell biology, 174(1):153-161.
Tsai et al. (Jun. 2014) "Dimeric CRISPR RNA-Guided FokI Nucleases for Highly Specific Genome Editing", Nature Biotechnology, 32(6):569-576 (22 pages).
Uhlen et al. (Jan. 23, 2015) "Tissue-based Map of the Human Proteome", Science, 347(6220):1260419(11 pages).
Ui-Tei et al. (2000) "Sensitive Assay of RNA Interference in *Drosophila* and Chinese Hamster Cultured Cells Using Firefly Luciferase Gene as Target", FEBS Letters, 479:79-82.
Vakulskas et al. (2019) "Evaluation and Reduction of CRISPR Off-Target Cleavage Events", Nucleic Acid Therapeutics, 29(4):167-174.
Van Buuren et al. (May 14, 2014) "High Sensitivity of Cancer Exome-Based CD8 T Cell Neo-Antigen Identification", Oncoimmunology, e28836, 3:6 pages.
Veres et al. (Jul. 3, 2014) "Low Incidence of Off-Target Mutations in Individual CRISPR-Cas9 and TALEN Targeted Human Stem Cell Clones Detected by Whole-Genome Sequencing", Cell Stem Cell, 15:27-30.
Vincent et al. (1997) "Mutation analysis of the transforming growth factor-beta type II receptor in human cell lines resistant to growth inhibition by transforming growth factor-beta", Oncogene, 15:117-122.
Vogelstein et al. (Apr. 14, 1989) "Allelotype of Colorectal Carcinomas", Science, 244(4901):207-211.
Vogelstein et al. (Mar. 29, 2013) "Cancer Genome Landscapes", Science, 339(6127):1546-1558.
Voss et al. (Dec. 2013) "Mechanism, Specificity, and Physiology of Signal Peptide Peptidase (SPP) and SPP-like Proteases", Biochimica Et Biophysica Acta (BBA)—Biomembranes, 1828(12):2828-2839.
Vyas et al. (Oct. 15, 2001) "Spatial organization of signal transduction molecules in the NK cell immune synapses during MHC class I-regulated noncytolytic and cytolytic interactions", The Journal of immunology, 167(8):4358-4367.
Walseng et al. (Sep. 6, 2017) "A TCR-based Chimeric Antigen Receptor", Scientific Reports, 7(1):10 pages.
Wang et al. (Jan. 1, 2004) "Loss of heterozygosity and its Correlation with Expression Profiles in Subclasses of Invasive Breast Cancers", Cancer research, 64(1):64-71.
Wang et al. (Oct. 2015) "Targeted Disruption of the β2-Microglobulin Gene Minimizes the Immunogenicity of Human Embryonic Stem Cells", Stem Cells Translational Medicine, 4(10):1234-1245.
Wilkie et al. (Oct. 2012) "Dual targeting of ErbB2 and MUC1 in breast cancer using chimeric antigen receptors engineered to provide complementary signaling", Journal of Clinical Immunology, 32(5):1059-1070.
Wootton et al. (Jun. 1993) "Statistics of Local Complexity in Amino Acid Sequences and Sequence Databases", Computers & Chemistry, 17(2):149-163.
Wu et al. (Oct. 16, 2015) "Remote Control of Therapeutic T Cells Through a Small Molecule-Gated Chimeric Receptor", Science, aab4077, 350(6258):21 pages.
Xu et al. (Oct. 2020) "Structure-Function Relationships of Chimeric Antigen Receptors in Acute T Cell Responses to Antigen", Molecular Immunology, 126:56-64.
Yeung et al. (Apr. 1, 2013) "LOH in the HLA class I region at 6p21 is Associated with Shorter Survival in Newly Diagnosed Adult Glioblastoma", Clinical Cancer Research, 19(7):1816-1826.
Zack et al. (Oct. 2013) "Pan-cancer Patterns of Somatic Copy Number Alteration", Nature Genetics, 45(10):1134-1140.
Zhang et al. (2017) "Phase I Escalating-Dose Trial of CAR-T Therapy Targeting CEA+ Metastatic Colorectal Cancers", Molecular Therapy, 25(5):1248-1258.
Zheng et al. (May 9, 2016) "Comprehensive Pan-Genomic Characterization of Adrenocortical Carcinoma", Cancer Cell, 29(5):723-736.
Zhou et al. (2018) "Accuracy, Safety, and Reliability of Novel Phase I Trial Designs", Clinical Cancer Research, 24(18):4357-4364.
Alcover et al. (Apr. 26, 2018) "Cell Biology of T Cell Receptor Expression and Regulation", Annual Review of Immunology, 36:103-125.
Campoli et al. (Oct. 6, 2008) "HLA Antigen Changes in Malignant Cells: Epigenetic Mechanisms and Biologic Significance", Oncogene, 27(45):5869-5885.
Chen et al. (Mar. 21, 2012) "Structural and Functional Distinctiveness of HLA-A2 Allelic Variants", Immunologic Research, 53:182-190.
Harrer et al. (May 2018) "Chimeric Antigen Receptors in Different Cell Types: New Vehicles Join the Race", Human Gene Therapy, 29(5):547-558.
Natali et al. (Sep. 1, 1989) Selective Changes in Expression of HLA Class I Polymorphic Determinants in Human Solid Tumors, Proceedings of the National Academy of Sciences of the United States of America, 86(17):6719-6723.
Norell et al. (Jun. 15, 2006) "Frequent Loss of HLA-A2 Expression in Metastasizing Ovarian Carcinomas Associated with Genomic Haplotype Loss and HLA-A2-Restricted HER-2/neu-Specific Immunity", Cancer Research, 66(12):6387-6394.
Skuljec et al. (Sep. 12, 2017) "Chimeric Antigen Receptor-Redirected Regulatory T Cells Suppress Experimental Allergic Airway Inflammation, a Model of Asthma", Frontiers in Immunology, Article 1125, 8:12 pages.

FIG. 1

| Gene | Colon adenocarcinoma<br>TCGA-COADREAD-Xena-Median-FPKM (383 samples) | Ovarian<br>TCGA-OV-Xena-Median-FPKM (427 samples) | Lung Adenocarcinoma<br>TCGA-LUAD-Xena-Median-FPKM (515 samples) | Pancreatic Adenocarcinoma<br>TCGA-PAAD-Xena-Median-FPKM (179 samples) | Mesothelioma<br>TCGA-MESO-Xena-Median-FPKM (87 samples) |
|---|---|---|---|---|---|
| VASN | 1.7 | 5.1 | 3.5 | 3.7 | 5.1 |
| TUSC3 | 1.8 | 5.0 | 4.8 | 4.9 | 5.3 |
| VSIG4 | 1.8 | 3.8 | 4.5 | 4.0 | 5.0 |
| CTXN1 | 0.3 | 6.6 | 2.1 | 2.1 | 5.0 |
| NPR1 | -0.4 | 5.2 | 1.2 | 1.3 | 5.5 |
| HAS1 | -3.0 | -3.6 | -2.7 | -0.6 | 5.7 |
| CD200 | 1.7 | 3.9 | 2.0 | 2.7 | 5.7 |
| LRRN4* | -4.0 | 0.5 | 1.3 | -1.8 | 5.0 |
| UPK3B* | -1.5 | 6.3 | 0.7 | 0.6 | 9.2 |
| PTGIS | -0.2 | 1.8 | 1.6 | 3.2 | 6.9 |
| SCARA3 | 0.7 | 5.7 | 2.0 | 3.2 | 5.7 |
| UPK1B | -10.0 | 2.4 | -4.3 | 0.9 | 6.7 |
| CLIC3 | 1.7 | 3.6 | 3.7 | 4.4 | 5.6 |

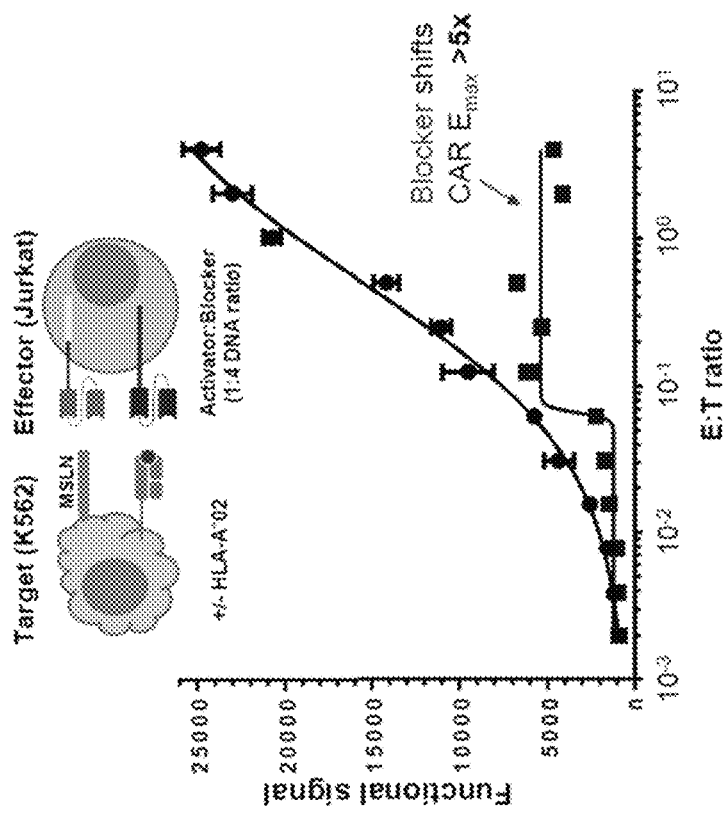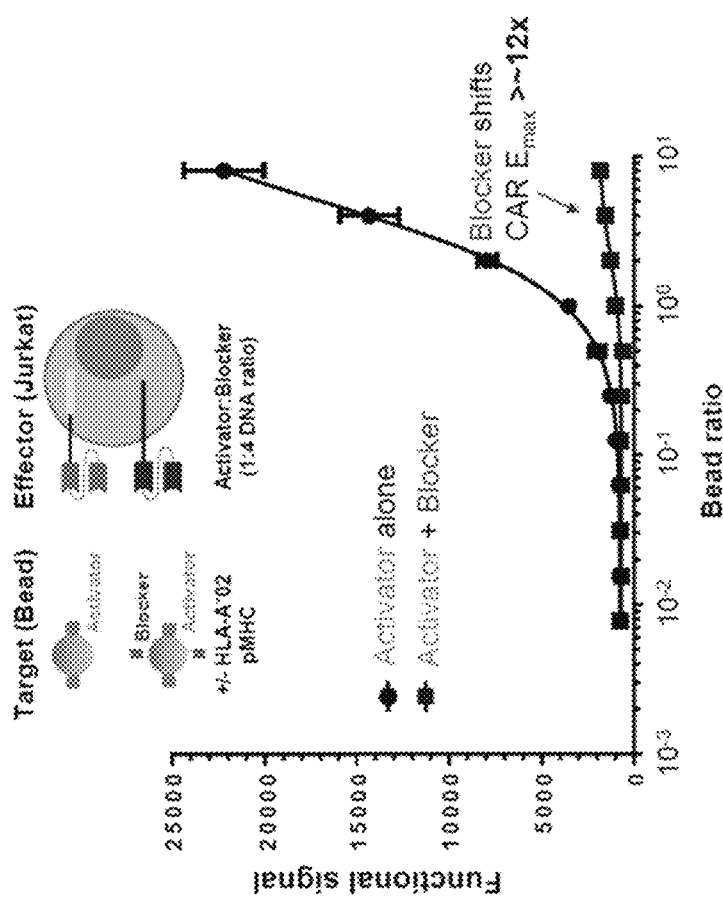
Activator = MSLN CAR; Blocker = A2-LIR-1

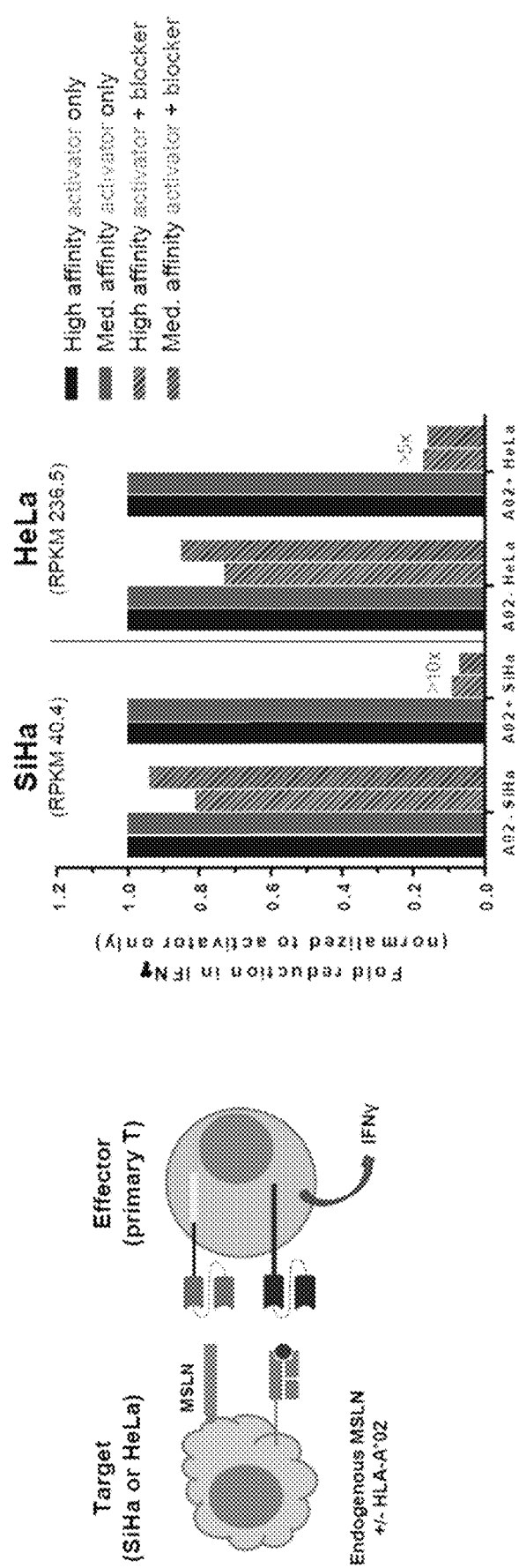

Source: Uniprot

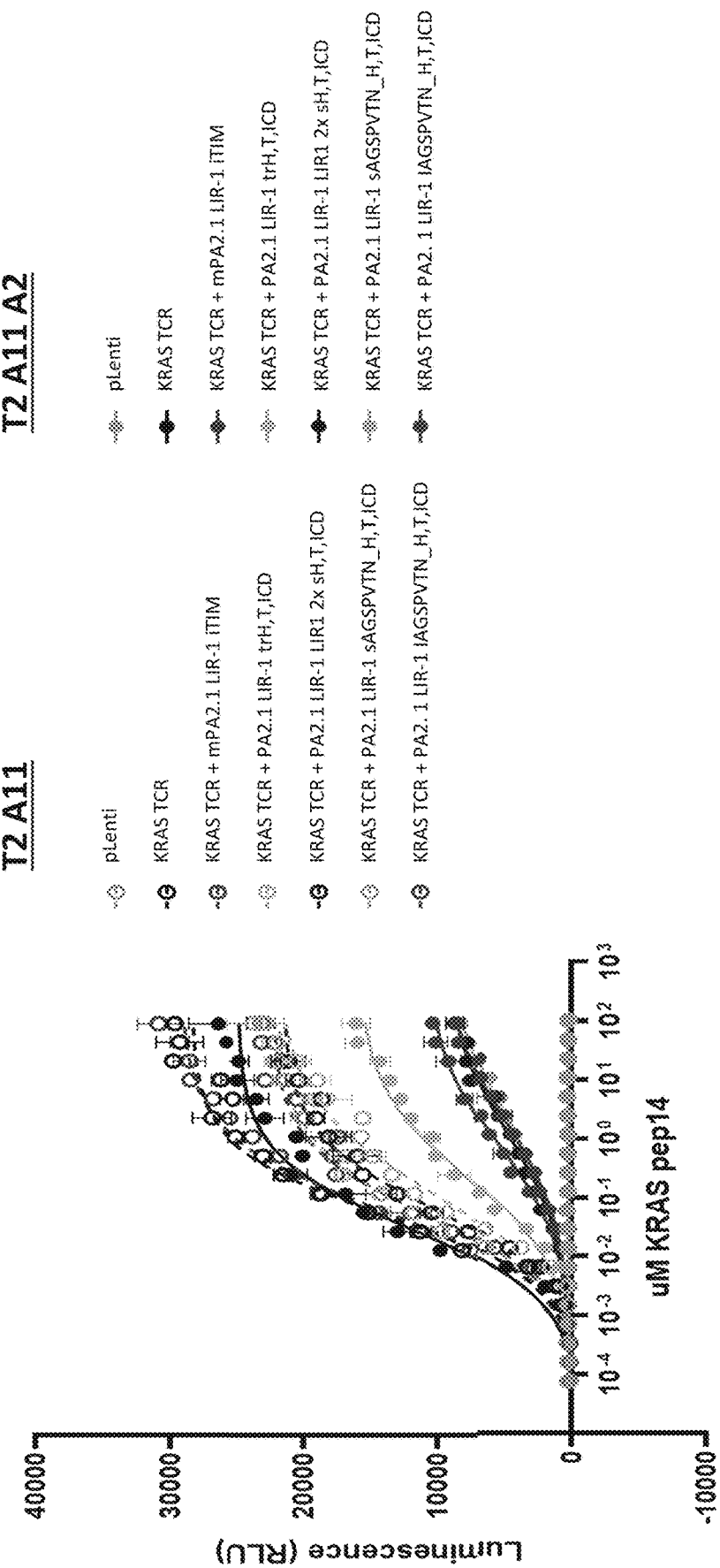

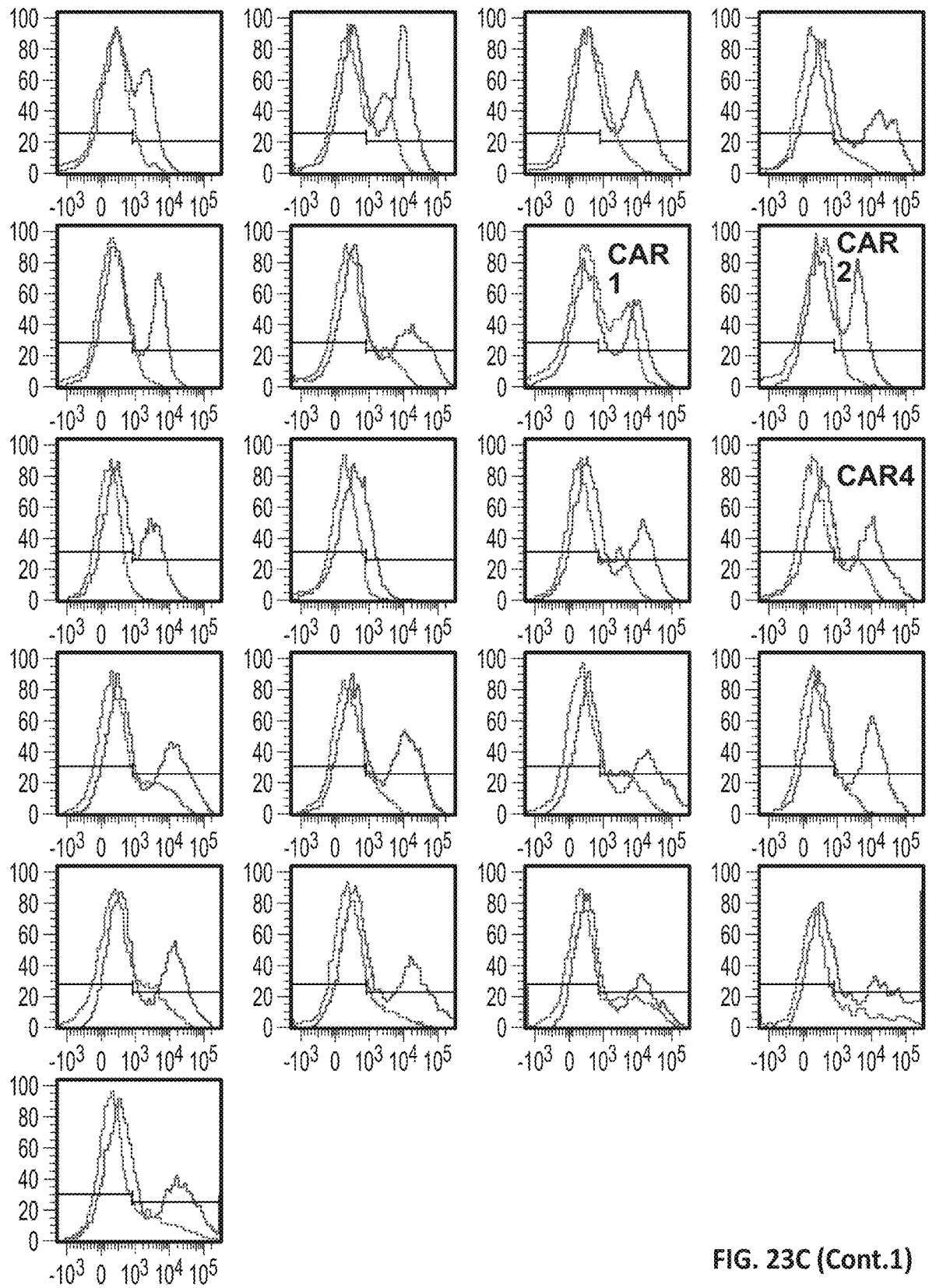
FIG. 23C (Cont.1)

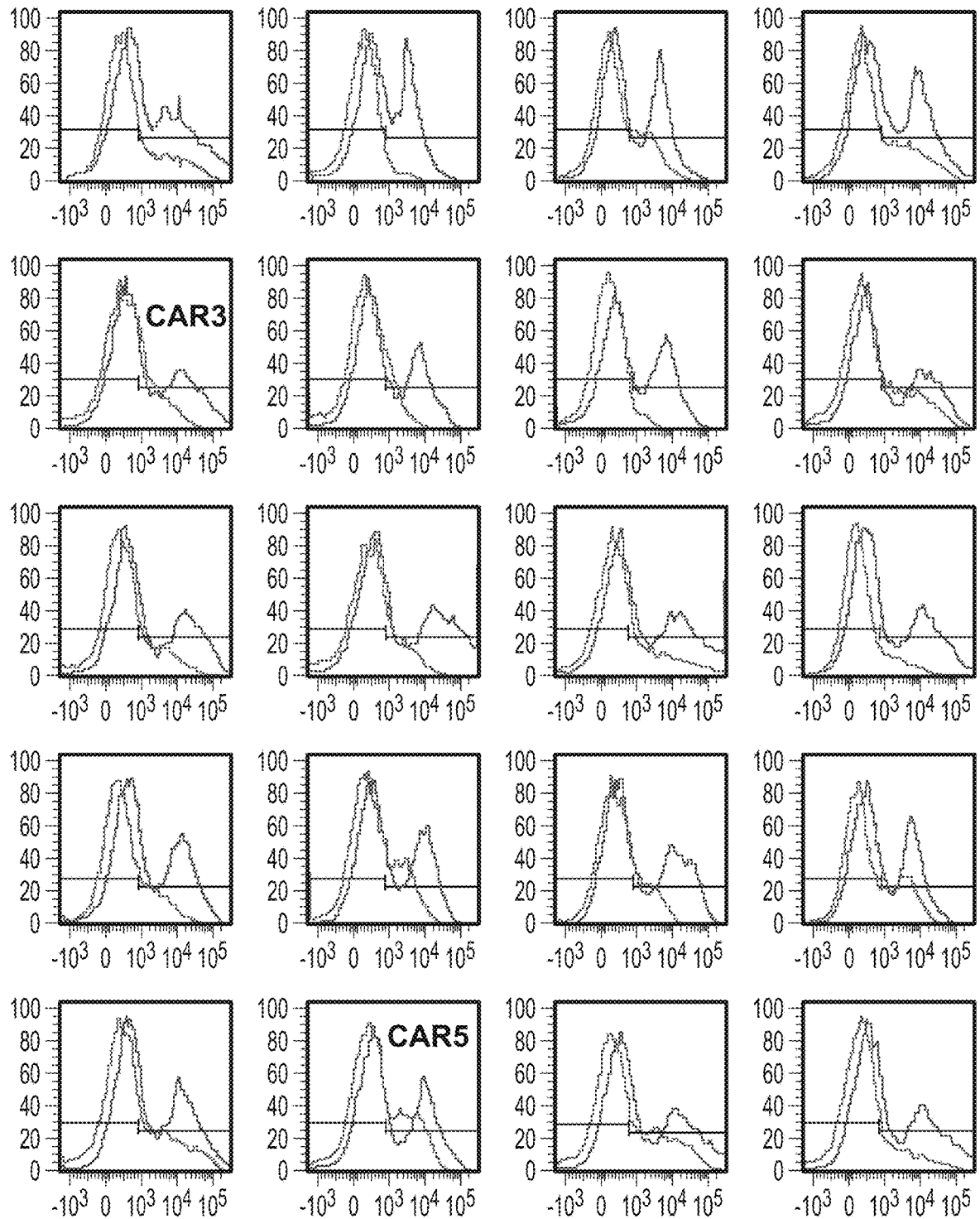
FIG. 23C (Cont.2)

FIG. 26A

| Tumor cell line | mRNA | | | Protein | | |
|---|---|---|---|---|---|---|
| | MSLN (TPM) | HLA-A (TPM) | A*02:MSLN ratio | MSLN (#mol/cell) | A*02 (#mol/cell) | A*02:MSLN ratio |
| MS751 (cervix; A*02:01, A*24:02) | 205 | 156 | 0.4 | 12,000 | 28,000 | 2.3 |
| MS751 (transduced with A*02) | 205 | 438 | 2.1 | 12,000 | 301,000 | 25 |
| HeLa (cervix; A*68:02, A*68:02; transduced with A*02) | 66 | 85 | na | 27,000 | 740,000 | 27 |
| NIH-OVCAR-3 (ovary; A*02:01, A*29:02) | 70 | 81 | 0.6 | 51,000 | 25,000 | 0.5 |
| U2OS (bone; A*02:01, A*32:01) | 25 | 108 | 2.2 | 9,600 | 18,000 | 1.9 |
| SW982 (synovium; A*02:01, A*02:01) | 22 | 533 | 24 | 12,000 | 240,000 | 20 |
| Tumor | MSLN (TPM) | A*02 (TPM) | A*02:MSLN ratio | | | |
| Lung adenocarcinoma | 371 | LOH | na | | | |
| Mesothelioma | 784 | LOH | na | | | |
| Ovarian | 511 | LOH | na | | | |
| Normal tissue (GTex) | MSLN (TPM) | HLA-A (TPM) | A*02:MSLN ratio | | | |
| Lung | 88 | 1934 | 22 | | | |

FIG. 26B

MSLN expression (molecules/cell) in cell lines used in study

|    | Cell line      | Avg    | Stan dev |
|----|----------------|--------|----------|
| 1  | NIH-OVCAR-3    | 51,000 | 12,000   |
| 2  | HeLa           | 27,000 | 1,900    |
| 3  | SW982          | 12,000 | 730      |
| 4  | MS751          | 12,000 | 1,700    |
| 5  | U2OS           | 9,600  | 2,800    |
| 6  | SW480          | 2,200  | 1,200    |
| 7  | HEPG2          | 1,900  | 120      |
| 8  | H508           | 1,000  | 400      |
| 9  | LnCAP cloneFGC | 930    | 220      |
| 10 | A498           | 820    | 39       |
| 11 | A375           | 630    | 170      |
| 12 | Raji           | 180    | 5        |
| 13 | SHP77          | 180    | -        |
| 14 | K562           | n/a    | n/a      |

M5 CAR; CAR3; CAR3 Tmod; Tumor target (solid); Normal target (open)

Primary T cell cytotoxicity assays

CAR; CAR + A*02 blocker; Tumor target (solid); Normal target (open)

Cytotoxicity assays +/- sMSLN sMSLN-stained CAR(+) Jurkat cells

M5 CAR
CAR3

Monomer sMSLN (dashed)
Tetramer sMSLN (solid)

COMPOSITIONS AND METHODS FOR TREATING MESOTHELIN POSITIVE CANCERS

CROSS-REFERENCE TO RELATED APPLICATIONS

This application is claims benefit of priority to U.S. Provisional Application No. 63/085,971, filed on Sep. 30, 2020, and U.S. Provisional Application No. 63/068,245, filed on Aug. 20, 2020, each of which is incorporated herein by reference in its entirety.

INCORPORATION BY REFERENCE OF SEQUENCE LISTING

The sequence listing paragraph application contains a Sequence Listing which has been submitted in ASCII format via EFS-WEB and is hereby incorporated by reference in its entirety. Said ASCII copy, created on Aug. 17, 2021 is named A2BI_019_03WO_SeqList_ST25.txt and is 1.08 MB in size.

TECHNICAL FIELD

The disclosure relates to the fields of adoptive cell therapy and cancer therapeutics.

BACKGROUND

Cell therapy is a powerful tool for the treatment of various diseases, particularly cancers. In conventional adoptive cell therapies, immune cells are engineered to express specific receptors, for example chimeric antigen receptors (CARs) or T cell receptors (TCRs), which direct the activity of the immune cells to cellular targets via interaction of the receptor with a ligand expressed by the target cell. Identification of suitable target molecules remains challenging, as many targets are expressed in normal tissues. This expression can lead to toxicity when the transplanted cells target normal tissues expressing target molecules. There is thus a need in the art for compositions and methods useful in the treatment of disease, particularly cancers, by adoptive cell therapy.

Mesothelin (MSLN) was proposed as a cancer target in 1992 (Chang et al. *Cancer Res* 52:181-86), yet there is still no viable therapy that utilizes MSLN. Not only is it expressed on most mesotheliomas but also large subsets of ovarian, cervical, uterine, gastric, pancreatic and lung adenocarcinomas. (Hassan et al. J Clin Oncol 34:4171-79) In normal adults, MSLN is present only in mesothelium, a tissue that itself may be nonessential. Several investigational therapeutics directed at MSLN have been tested; for example, immunotoxin-conjugates, antibody-drug conjugates, bispecific antibodies, CAR-Ts, and a hybrid TCR-scFv.

All active systemically administered therapeutics have been toxic. Accordingly, there exists a need in the art for compositions and methods related to treatment of MSLN(+) cancers.

SUMMARY

Provided herein are compositions and methods related to treatment of MSLN(+) cancers. Advantageously, the compositions and methods disclosed herein may exploits loss of heterozygosity (LOH) to address MSLN(+) cancer. The compositions and methods disclosed herein may, in some cases, avoid systemic toxicity to normal tissues by pairing a MSLN-targeted activator receptor with a blocker receptor. Without being bound by theory, the difference in blocker antigen expression in tumor versus. normal tissues caused by LOH at the locus encoding the blocker antigen may confer high selectivity for tumor killing.

The disclosure provides immune cells comprising: (a) a first receptor, comprising an extracellular ligand binding domain specific to Mesothelin (MSLN); and (b) a second receptor, comprising an extracellular ligand binding domain specific to a non-target antigen lost in a MSLN+ cancer cell, wherein the first receptor is an activator receptor responsive to MSLN; and wherein the second receptor is an inhibitory receptor responsive to the non-target antigen.

In some embodiments of the immune cells of the disclosure, the non-target antigen is lost in the MSLN+ cancer cell through loss of heterozygosity.

In some embodiments of the immune cells of the disclosure, the extracellular ligand binding domain of the second receptor specifically binds an allelic variant of a major histocompatibility complex (MHC) protein. In some embodiments, the extracellular ligand binding domain of the second receptor specifically binds an allelic variant of an HLA-A, HLA-B, or HLA-C protein. In some embodiments, the extracellular ligand binding domain of the second receptor specifically binds to HLA-A*01, HLA-A*02, HLA-A*03, HLA-A*11, HLA-B*07, or HLA-C*07. In some embodiments, the extracellular ligand binding domain of the second receptor specifically binds to HLA-A*02. In some embodiments, the extracellular ligand binding domain of the second receptor comprises complementarity determining regions (CDRs) CDR-L1, CDR-L2, CDR-L3, CDR-H1, CDR-H2, CDR-H3 as disclosed Table 6; or CDR sequences having at most 1, 2, or 3 substitutions, deletions, or insertion relative to the CDRs of Table 6 or Table 7. In some embodiments, the extracellular ligand binding domain of the second receptor comprises complementarity determining regions (CDRs) CDR-L1, CDR-L2, CDR-L3, CDR-H1, CDR-H2, CDR-H3 of SEQ ID NOS: 42-47 or of SEQ ID NOS: 48-53; or CDR sequences having at most 1, 2, or 3 substitutions, deletions, or insertion relative to the CDRs of SEQ ID NOS: 42-47 or SEQ ID NOS: 48-53. In some embodiments, the extracellular ligand binding domain of the second receptor comprises a polypeptide sequence selected from the polypeptide sequence disclosed in Table 5; or a sequence having at least 85%, at least 90%, at least 95%, at least 97% or at least 99% identity thereto. In some embodiments, the extracellular ligand binding domain of the second receptor comprises any one of SEQ ID NOS: 30-41, or a sequence having at least 85%, at least 90%, at least 95%, at least 97% or at least 99% identity thereto.

In some embodiments of the immune cells of the disclosure, the first receptor is a chimeric antigen receptor (CAR). In some embodiments, the extracellular ligand binding domain of the first receptor comprises complementarity determining regions (CDRs) CDR-L1, CDR-L2, CDR-L3, CDR-H1, CDR-H2, CDR-H3 as disclosed Table 2; or CDR sequences having at most 1, 2, or 3 substitutions, deletions, or insertions relative to the CDRs of Table 2. In some embodiments, the extracellular ligand binding domain of the first receptor comprises a variable heavy (VH) portion comprising a sequence set forth in Table 3 and a variable light (VL) portion comprising a sequence set forth in Table 4; or a sequence having at least 80%, at least 90%, at least 95%, at least 97% or at least 99% identity thereto. In some embodiments, the extracellular ligand binding domain of the first receptor comprises a variable heavy (VH) portion comprising SEQ ID NO: 233 or a sequence having at least 85%, at least 90%, at least 95%, at least 97%, or at least 99% identity thereto, and a variable light (VL) portion comprising SEQ ID NO: 279 or a sequence having 85%, at least 90%, at least 95%, at least 97%, or at least 99% identity thereto. In some embodiments, the extracellular ligand binding domain of the first receptor comprises a sequence selected from the group consisting of SEQ ID NOS: 3-6, 80 and 154-215, or a sequence having at least 85%, at least 90%, at least 95%, at least 97%, or at least 99% identity thereto. In some embodiments, the extracellular ligand binding domain of the first receptor comprises an scFv sequence of SEQ ID NO: 171; or a sequence having at least 85%, at least 90%, at least 95%, at least 97% or at least 99% identity thereto.

In some embodiments of the immune cells of the disclosure, the first receptor comprises a hinge domain, a transmembrane domain and an intracellular domain. In some embodiments, the hinge domain comprises a CD8a hinge domain. In some embodiments, the CD8a hinge domain comprises a sequence of SEQ ID NO: 7, or a sequence having at least 85%, at least 90%, at least 95%, at least 97% or at least 99% identity thereto. In some embodiments, the transmembrane domain comprises a CD28 transmembrane domain. In some embodiments, the CD28 transmembrane domain comprises a sequence of SEQ ID NO: 11, or a sequence having at least 85%, at least 90%, at least 95%, at least 97% or at least 99% identity thereto. In some embodiments, the intracellular domain comprises a CD28 co-stimulatory domain, a 4-1BB co-stimulatory domain, and a CD3ζ activation domain. In some embodiments, the intracellular domain comprises a sequence of SEQ ID NO: 285, or a sequence having at least 85%, at least 90%, at least 95%, at least 97% or at least 99% identity thereto. In some embodiments, the first receptor comprises a sequence of SEQ ID NO: 303, or a sequence having at least 90%, at least 95%, at least 97% or at least 99% identity thereto.

In some embodiments of the immune cells of the disclosure, the second receptor comprises a LILRB1 intracellular domain or a functional variant thereof. In some embodiments, the LILRB1 intracellular domain comprises a sequence at least 90%, at least 95%, at least 97%, at least 99%, or is identical to SEQ ID NO: 70. In some embodiments, the second receptor comprises a LILRB1 transmembrane domain or a functional variant thereof. In some embodiments, the LILRB1 transmembrane domain or a functional variant thereof comprises a sequence at least 90%, at least 95%, at least 97%, at least 99% or is identical to SEQ ID NO: 74. In some embodiments, the second receptor comprises a LILRB1 hinge domain or functional variant thereof. In some embodiments, the LILRB1 hinge domain comprises a sequence at least 90%, at least 95%, at least 97%, at least 99% or is identical to SEQ ID NO: 73. In some embodiments, the second receptor comprises a LILRB1 intracellular domain, a LILRB1 transmembrane domain, a LILRB1 hinge domain, a functional variant of any of these, or combinations thereof. In some embodiments, the LILRB1 hinge domain, LILRB1 intracellular domain and LILRB1 transmembrane domain comprises SEQ ID NO: 71 or a sequence at least 90%, at least 95%, at least 97%, at least 99% or is identical to SEQ ID NO: 71. In some embodiments, the second receptor comprises a sequence of SEQ ID NO: 348, or a sequence having at least 90%, at least 95%, at least 97%, or at least 99% identity thereto.

In some embodiments of the immune cells of the disclosure, the MSLN+ cancer cell is a mesothelioma cancer cell, an ovarian cancer cell, a cervical cancer cell, a colorectal cancer cell, an esophageal cancer cell, a head and neck cancer cell, a kidney cancer cell, an uterine cancer cell, a gastric cancer cell, a pancreatic cancer cell, a lung cancer cell, a colorectal cancer cell or a cholangiocarcinoma cell, or any cancer cell expressing MSLN. In some embodiments, the MSLN+ cancer cell is a mesothelioma cancer cell, an ovarian cancer cell, a cervical cell, a uterine cancer cell, a gastric cancer cell, a pancreatic cancer cell or a lung adenocarcinoma cell.

In some embodiments, the MSLN+ cancer cell is an epithelial cancer cell. Epithelial cancers are cancers that originate in the epithelial cells. In some embodiments, the MSLN+ epithelial cancer is a carcinoma.

In some embodiments of the immune cells of the disclosure, the MSLN+ cancer cell is a MSLN+/HLA-A*02− cancer cell that does not express HLA-A*02. In some embodiments, the MSLN+/HLA-A*02− cancer cell is derived from a MSLN+/HLA-A*02+ cell by loss of heterozygosity at HLA-A leading to loss of HLA-A*02. In some embodiments, the first receptor and the second receptor together specifically activate the immune cell in the presence of the MSLN+/HLA-A*02− cancer cell having loss of heterozygosity. In some embodiments, the first receptor and the second receptor together do not specifically activate the immune cell in the presence of an MSLN+ cell that has not lost HLA-A*02 by loss of heterozygosity.

In some embodiments of the immune cells of the disclosure, the immune cell is a T cell. In some embodiments, the T cell is a CD8+CD4− T cell.

In some embodiments of the immune cells of the disclosure, expression and/or function of a MHC Class I gene has been reduced or eliminated. In some embodiments, the MHC Class I gene is beta-2-microglobulin (B2M). In some embodiments, the immune cells further comprise an interfering RNA, the interfering RNA comprising a sequence complementary to a sequence of a B2M mRNA. In some embodiments, the interfering RNA comprises a sequence selected from the group of sequences set forth in Table 13, or a sequence having at most 1, 2, 3, or 4 substitutions, insertions or deletions relative thereto. In some embodiments, the interfering RNA is capable of inducing RNAi-mediated degradation of the B2M mRNA. In some embodiments, the interfering RNA is a short hairpin RNA (shRNA). In some embodiments, the shRNA comprises: (a) a first sequence, having from 5' end to 3' end a sequence complementary to a sequence of the B2M mRNA; and (b) a second sequence, having from 5' end to 3' end a sequence complementary to the first sequence, wherein the first sequence and the second sequence form the shRNA. In some embodiments, the shRNA is encoded by a sequence comprising a sequence of GCACTCAAAGCTTGTTAA-GATCGAAATCTTAACAAGCTTTGAGTGC (SEQ ID NO: 349) or GTTAACTTCCAATTTACAT-ACCGAAGTATGTAAATTGGAAGTTAAC (SEQ ID NO: 350), or a sequence having at least 80%, at least 90%, or at least 95% identity thereto.

In some embodiments of the immune cells of the disclosure, expression and/or function of a MHC Class I gene has been reduced or eliminated. In some embodiments, the MHC Class I gene is beta-2-microglobulin (B2M). In some embodiments, the immune cells comprise one or more modifications to a sequence encoding B2M, wherein the one or more modifications reduce the expression and/or eliminate the function of B2M. In some embodiments, the one or more modifications comprise one or more inactivating mutations of the endogenous gene encoding B2M. In some embodiments, the one or more inactivating mutations comprise a deletion, an insertion, a substitution, or a frameshift mutation. In some embodiments, the one or more inactivating mutations are introduced with a nucleic acid guided endonuclease in a complex with at least one guide In some embodiments e nucleic acid (gNA) that specifically targets a sequence of the endogenous gene encoding B2M. In some embodiments, the gNA comprises a sequence selected from the group of sequences set forth in Table 12, or a sequence having at most 1, 2, 3, or 4 substitutions, insertions or deletions relative thereto.

In some embodiments of the immune cells of the disclosure, expression and/or function of a MHC Class I gene has been reduced or eliminated. In some embodiments, the MHC Class I gene is HLA-A*02. In some embodiments, the immune cells comprise a polynucleotide comprising an interfering RNA, comprising a sequence complementary to a sequence of an HLA-A*02 mRNA. In some embodiments, the interfering RNA is capable of inducing RNA interference (RNAi)-mediated degradation of the HLA-A*02 mRNA. In some embodiments, the interfering RNA is a short hairpin RNA (shRNA) comprising: (a) a first sequence, having from 5' end to 3' end a sequence complementary to a sequence of the HLA-A*02 mRNA; and (b) a second sequence, having from 5' end to 3' end a sequence complementary to the first sequence, wherein the first sequence and the second sequence form the shRNA. In some embodiments, the shRNA comprises a sequence set forth in 14. In some embodiments, the immune cells comprise one or more modifications to a sequence of an endogenous gene encoding HLA-A*02, wherein the one or modifications reduce the expression and/or eliminate the function of HLA-A*02. In some embodiments, the one or more modifications comprise one or more inactivating mutations of the endogenous gene encoding HLA-A*02. In some embodiments, the one or more inactivating mutations are introduced with a nucleic acid guided endonuclease in a complex with at least one guide nucleic acid (gNA) that specifically targets a sequence of the endogenous gene encoding HLA-A*02. In some embodiments, the gNA comprises a sequence set forth in Table 11.

In some embodiments of the immune cells of the disclosure, the first receptor comprises a sequence of SEQ ID NO: 164, and the second receptor comprises a sequence of SEQ ID NO: 52, or sequences having at least 90%, at least 95%, at least 97% or at least 99% identity thereto. In some embodiments, the immune cells comprise an shRNA encoded by a sequence comprising GCACT-CAAAGCTTGTTAAGATCGAAATCTTAACAAGCTTT-GAGTGC (SEQ ID NO: 349) or GTTAACTTCCAATTTA-CATACCGAAGTATGTAAATTGGAAGTTAAC (SEQ ID NO: 350) or a sequence having at least 80%, at least 90%, or at least 95% identity thereto. In some embodiments, the first receptor and second receptor are encoded by a single polynucleotide, and wherein the sequences encoding the first and second receptors are separated by a sequence encoding a self-cleaving polypeptide. In some embodiments, the self-cleaving polypeptide comprises a T2A self-cleaving polypeptide comprising a sequence of GSGEGRGSLLTCGD-VEENPGP (SEQ ID NO: 351).

In some embodiments of the immune cells of the disclosure, the immune cells are autologous.

In some embodiments of the immune cells of the disclosure, the immune cells are allogeneic.

The disclosure provides a pharmaceutical composition, comprising a therapeutically effective amount of the immune cells of the disclosure. In some embodiments, the pharmaceutical composition further comprises a pharmaceutically acceptable carrier, diluent or excipient.

The disclosure provides a pharmaceutical composition, comprising a therapeutically effective amount of the immune cells of the disclosure for use as a medicament in the treatment of MSLN+ cancer.

The disclosure provides a polynucleotide or polynucleotide system, comprising one or more polynucleotides comprising polynucleotide sequences encoding: (a) a first receptor, comprising an extracellular ligand binding domain specific to Mesothelin (MSLN); and (b) a second receptor, comprising an extracellular ligand binding domain specific to a non-target antigen that has been lost in a MSLN+ cancer cell, wherein the first receptor is an activator receptor responsive to MSLN on the MSLN+ cancer cell; and wherein the second receptor is an inhibitory receptor responsive to the non-target antigen.

In some embodiments of the polynucleotide or polynucleotide system of the disclosure, the polynucleotide or polynucleotide system comprises one or more polynucleotides comprising polynucleotide sequences encoding the first receptor and the second receptor for use in generating the immune cells of the disclosure. In some embodiments, the polynucleotide or polynucleotide system comprises a sequence encoding an shRNA specific to B2M. In some embodiments, the sequences encoding the first receptor, the second receptor and the shRNA specific to B2M are encoded by the same polynucleotide. In some embodiments, (a) the sequence encoding the shRNA specific to B2M comprises GCACTCAAAGCTTGTTAAGATCGAAATCT-TAACAAGCTTTGAGTGC (SEQ ID NO: 349) or GTTAACTTCCAATTTACATACCGAAGTATGTAAAT-TGGAAGTTAAC (SEQ ID NO: 350) or a sequence having at least 80%, at least 90%, or at least 95% identity thereto; (b) the sequence encoding the first receptor comprises a sequence encoding a polypeptide of SEQ ID NO: 303, or a sequence having at least 80%, at least 90%, or at least 95% identity thereto; and (c) the sequence encoding the second receptor comprises a sequence encoding a polypeptide of SEQ ID NO: 348, or a sequence having at least 80%, at least 90%, or at least 95% identity thereto.

The disclosure provides a vector, comprising the one or more polynucleotides of the disclosure.

The disclosure provides methods of killing a MSLN+ cancer cell having loss of heterozygosity at an MHC class I locus, comprising administering to the subject an effective amount of the immune cells or pharmaceutical composition of the disclosure.

The disclosure provides methods of treating MSLN+ cancer in a subject having a MSLN+ tumor having loss of heterozygosity at an MHC class I locus, comprising administering to the subject an effective amount of the immune cells or pharmaceutical composition of the disclosure.

The disclosure provides methods of treating a cancer in a subject comprising: (a) determining HLA-A genotype or expression of normal cells and a plurality of cancer cells of the subject; (b) optionally, determining the expression of MSLN in a plurality of cancer cells of the subject; and (c) administering to the subject an effective amount of the immune cells or pharmaceutical composition of the disclosure if the normal cells express HLA-A*02 and the plurality of cancer cells do not express HLA-A*02, and the plurality of cancer cells are MSLN-positive.

In some embodiments of the methods of the disclosure, the subject is a heterozygous HLA-A*02 patient with a malignancy that expresses MSLN (MSLN+) and has lost HLA-A*02 expression. In some embodiments, the subject is a heterozygous HLA-A*02 patient with recurrent unresectable or metastatic solid tumors that express MSLN and have lost HLA-A*02 expression. In some embodiments, the cancer comprises mesothelioma cancer, ovarian cancer, cervical cancer, colorectal cancer, esophageal cancer, head and neck cancer, kidney cancer, uterine cancer, gastric cancer, pancreatic cancer, lung cancer, colorectal cancer, or cholangiocarcinoma. In some embodiments, the cancer comprises mesothelioma, ovarian cancer, cervical cancer, uterine cancer, gastric cancer, pancreatic cancer or lung adenocarcinoma. In some embodiments, the cancer has relapsed in a subject. In some embodiments, the cancer is refractory to one or more prior administered anticancer therapies. In some embodiments, the cancer is metastatic.

In some embodiments of the methods of the disclosure, the cancer cells comprise MSLN+/HLA-A*02− cancer cells that do not express HLA-A*02. In some embodiments, the MSLN+/HLA-A*02− cancer cells are derived from a MLSN+/HLA-A*02+ cell by loss of heterozygosity at HLA-A leading to loss of HLA-A*02. In some embodiments, the first receptor and the second receptor together specifically activate the immune cell in the presence of the MSLN+/HLA-A*02− cancer cells. In some embodiments, the first receptor and the second receptor together do not specifically activate the immune cell in the presence of a MSLN+ cell that has not lost HLA-A*02.

In some embodiments of the methods of the disclosure, administration of the immune cells or pharmaceutical composition reduces the size of a tumor in the subject. In some embodiments, the tumor is reduced by about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, or about 100%. In some embodiments, the tumor is eliminated.

In some embodiments of the methods of the disclosure, administration of the immune cells or pharmaceutical composition arrests the growth of a tumor in the subject.

In some embodiments of the methods of the disclosure, administration of the immune cells or pharmaceutical composition reduces the number of tumors in the subject.

In some embodiments of the methods of the disclosure, administration of the immune cells or pharmaceutical composition results in selective killing of a cancer cell but not a normal cell in the subject. In some embodiments, at least about 60% of the cells killed are cancer cells, about 65% of the cells killed are cancer cells, about 70% of the cells killed are cancer cells, about 75% of the cells killed are cancer cells, about 80% of the cells killed are cancer cells, about 85% of the cells killed are cancer cells, about 90% of the cells killed are cancer cells, about 95% of the cells killed are cancer cells, or about 100% of the cells killed are cancer cells. In some embodiments, administration of the immune cell or pharmaceutical composition results in the killing of at least about 40%, about 50%, about 60%, about 70%, about 80%, about 90% or all of the cancer cells of the subject.

In some embodiments of the methods of the disclosure, administration of the immune cell or the pharmaceutical composition results in fewer side effects for the subject than administration of an otherwise equivalent immune cell comprising the first activator receptor but no second inhibitory receptor.

The disclosure provides methods making a plurality of immune cells, comprising: (a) providing a plurality of immune cells, and (b) transforming the plurality of immune cells with the polynucleotide, polynucleotide system or vector of the disclosure.

The disclosure provides kits comprising the immune cells or pharmaceutical composition of the disclosure. In some embodiments, the kits further comprise instructions for use.

BRIEF DESCRIPTION OF THE DRAWINGS

FIG. 1 is a table showing expression of blocker candidate genes from the TCGA database. (*) indicates genes previously identified as being expressed in the mesothelium.

FIG. 10A shows that a pMHC HLA-A*02 scFv LIR-1 based inhibitory receptor can inhibit activation of Jurkat cells in cis in a cell-free bead based assay.

FIG. 10B that a pMHC HLA-A*02 scFv LIR-1 based inhibitory receptor can inhibit activation of Jurkat cells by a MSLN scFv CAR using the leukemia cell line K562 as target cells.

FIG. 11 is a diagram (left) and a chart (right) showing that a pMHC HLA-A*02 scFv LIR-1 based inhibitory receptor can inhibit activation of Jurkat cells, as measured by fold induction of IFNγ, by a MSLN scFv CAR using a pMHC HLA-A*02 scFv LIR-1 based inhibitory receptor and HLA-A*02+ HeLa and SiHa cells as target cells.

FIG. 21A is a plot showing the effect of LIR-1 hinge on the ability of an HLA-A*02 inhibitory receptor to block activation of Jurkat cells by a KRAS TCR. H: hinge, TM: transmembrane domain, ICD: intracellular domain, s: short; tr: truncated. LIR-1 constructs are described in more detail in FIG. 21B. Mouse PA2.1 with slightly longer hinges function similarly to original LIR-1 hinge in T2-Jurkat assay.

FIG. 22A shows the lung (and other vital organs) are surrounded by the MSLN(+) mesothelial lining, creating high risk of on-target, off-tumor toxicity for MSLN-targeted medicines. By selecting patients heterozygous for HLA-A*02 whose tumors have lost this allele via LOH, there is an opportunity to target MSLN-activated CAR-T cells to kill tumor cells specifically and spare normal mesothelium. FIG. 22B shows the molecular composition of MSLN-targeted Tmod constructs (Tmod refers to the paired activator and inhibitory receptors). The two receptors are co-expressed in a single construct and the encoded fusion protein is cleaved in the cell to generate the activator and blocker.

FIG. 23A shows enrichment of IgG library. FIG. 23B shows enrichment of scFv library. FIG. 23C shows surface expression of MSLN CARs (Gen3) in Jurkat cells. Cells were transfected with CAR constructs and stained with Protein L or monomeric soluble MSLN (see Methods). Benchmark and CAR1-6 expression histograms are labeled. PE, phycoerythrin; NA, neutravidin; SA, streptavidin. "On-target NGS" corresponds to the cell populations that are collected and subjected to DNA sequencing to determine enrichment of individual idiotypes.

FIG. 23D shows the characterization of MSLN binders in solid-state Jurkat cell assays with MSLN protein attached to the surface (see Hamburger et al., 2020). 62 CAR constructs (Gen3) bearing different scFvs were transiently transfected in Jurkat cells to express CARs and a functional response to surface-bound recombinant human sMSLN (Acro Bio) was assessed after 6 hours. Most resulted in some degree of response.

FIG. 26A shows a summary of cell lines used in this study. Quantification of surface densities of MSLN and A*02 in various cancer cell lines, and corresponding reported mRNA levels in normal lung tissue (GTEx). Surface MSLN and A*02 of engineered and wildtype tumor cell lines was quantified using a QIFIKIT (quantitative analysis kit, Agilent). Where cell line HLA-A haplotypes are heterozygous for A*02, the TPM values were divided by 2. Note that in certain cases the HLA-A allele copy number is not known. The TPM value of MS751+transduced A*02 (438 TPM) was estimated from measurement of its surface A*02 protein level using the standard curve. Cell lines transduced with HLA-A*02 better mimic the A*02:MSLN ratio of normal lung tissue than cell lines expressing endogenous levels of the proteins (bold black boxes). TPM, transcripts per million; na, not applicable; A*02: HLA-A*02.

FIG. 26B shows quantification of MSLN molecules/cell using QIFIKIT. Anti-human MSLN mouse antibody clone 618923 (R&D Systems) was used to stain ~100,000 cells. After washing the cells, anti-mouse IgG F(ab')2 secondary antibody (Invitrogen A21237) was used to stain both the cells and QIFI beads. The number of MSLN molecules on the surface was quantified using the QIFI antigen standard curve.

FIG. 34A shows a schematic diagram of the dual-flank tumor and normal MS751 xenograft model. FIG. 34B shows bioluminescence values are to the right of the color scale in flux units of photons/sec/cm2/sr. Day 0=pre T cell injection; days 8 and 15=post T cell injection. FIG. 34C shows graft sizes assessed by caliper measurement (see Results for Example 8, infra).

FIG. 35A shows primary T cells transduced with MSLN CARs or CAR3 Tmod were co-cultured with either HLA-A KO tumor or A*02-transgenic normal MS751 target cells in vitro at an E:T=1.4:1 for 48 hours. M5 was a Gen2 CAR; all others Gen3. Tumor=MSLN(+)A*02(−) target cells; Normal=MSLN(+)A*02(+) target cells. FIG. 35B shows individual mouse xenograft growth curves for data shown in FIG. 34C. FIG. 35C shows BLI quantification of normal and tumor cells post T cell injection.

FIG. 37A shows cis-binding of autologous A*02 in an A*02(+) donor eliminates binding to A*02 tetramer B2M knockout (KO) by CRISPR restores blocker availability as demonstrated by binding to A*02 tetramer, similar to observed levels in an A*02(−) donor. FIG. 37B shows a cytotoxicity assay showing activator-only and MSLN SS1 CAR Tmod primary T cells cultured with tumor (solid) or normal (open) target cells. MSLN SS1 CAR Tmod construct kills MSLN (+) A*02(−) tumor HeLa target cells but no longer blocks in the presence of autologous A*02 as a result of cis-binding. For the A*02(+) donor, blocking is only achieved through B2M CRISPR KO. E:T=1.2:1. FIG. 37C shows representative images at 48 h.

FIG. 39C shows representative co-culture images at 48 hours for FIG. 39B.

DETAILED DESCRIPTION

Provided herein are compositions and methods for treating cancers using immune cells comprising a two receptor system responsive to differences in gene expression of a ligand between cancer and normal (i.e. healthy or wild type) cells. These differences in expression can be due to loss of heterozygosity in the cancer cells. Alternatively, the differences in expression can be because the gene expression is not expressed in cancer cells, or is expressed in cancer cells at a lower level than normal cells. The two-receptor system is expressed in immune cells, for example immune cells used in adoptive cell therapy, and targets activity of these immune cells to cancer cells exhibiting loss of heterozygosity or expression differences. In this two receptor system, the first receptor (an activator receptor, sometimes referred to herein as an A module) activates, or promotes activation of the immune cells, while the second receptor (an inhibitory receptor, sometimes referred to herein as a blocker, inhibitor receptor, or B module) acts to inhibit activation of the immune cells by the first receptor. Each receptor contains a ligand-binding domain (LBD) that binds a specific ligand. Signals from the two receptors upon ligand binding are integrated by the immune cell. Differential expression of ligands for the first and second receptors in cancer and normal cells, for example through loss of heterozygosity of the locus encoding the inhibitory ligand in cancer cells, or differences in transcription levels, mediates activation of immune cells by target cancer cells that express the first activator ligand but not the second inhibitory ligand.

Loss of heterozygosity (LOH) from large-scale chromosomal deletions is a source of genetic difference in tumors. LOH is a common event in tumorigenesis which affects nearly every locus in the genome, with approximately 20% of genes displaying LOH in an average tumor. LOH provides the means to discriminate tumor from normal tissue in a definitive way because tumors can be found in which all malignant cells lack certain germline alleles. One locus that undergoes LOH is the human leukocyte antigen (HLA) locus, which encodes polymorphic, abundant, ubiquitous surface antigens. The two-receptor system described herein employs one receptor to activate T cells exposed to tumor-antigen-positive tumor cells (sometimes referred to as an "activator module"), and a second receptor to prevent activation of the immune cells in the presence of a surface blocker antigen such as HLA-A*02 protein. The dual-receptor system described herein (sometimes referred to herein as "Tmod") possesses other advantageous properties as a cell therapy, including but not limited to reversible activation/blockade of immune cells, and selectivity in mixtures of tumor and "normal" cells.

Figure 2:
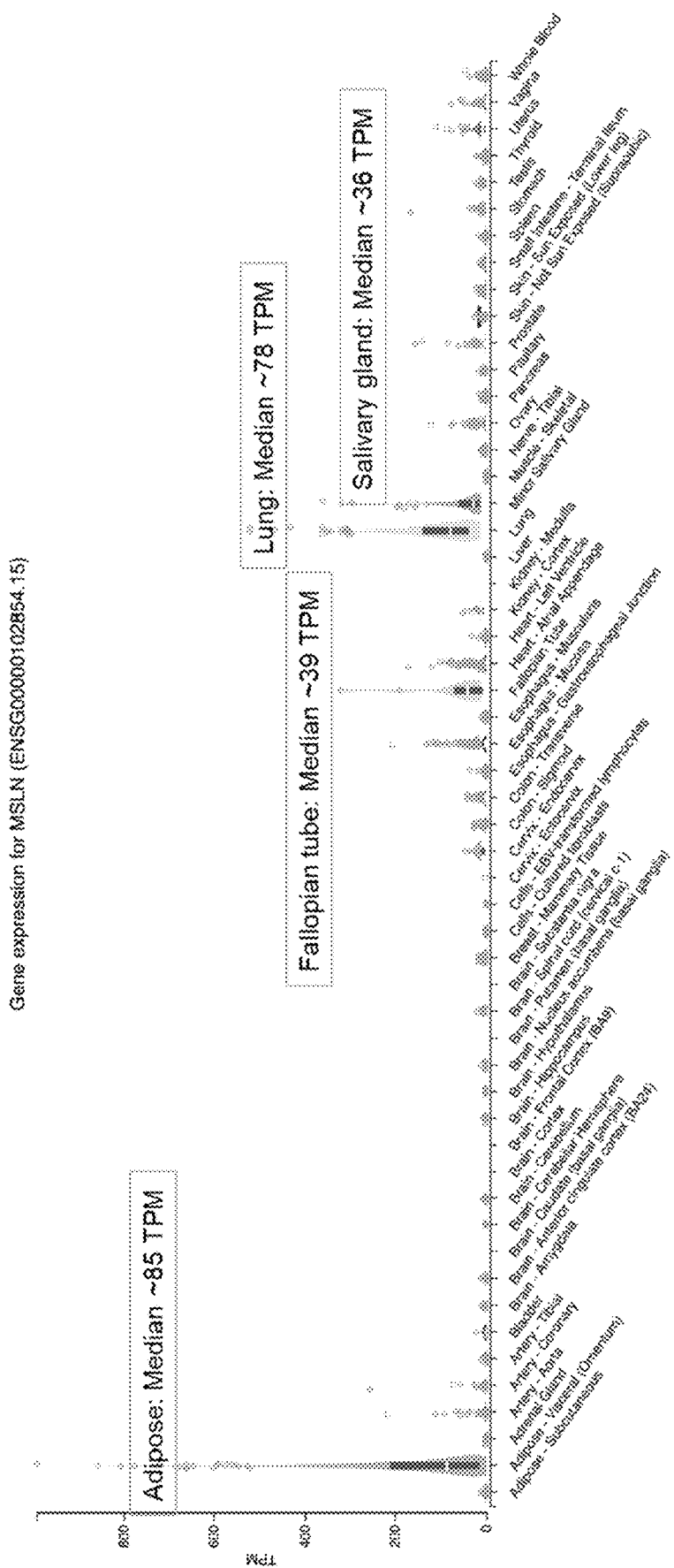
FIG. 2 is a plot showing Mesothelin (MSLN) expression in normal tissues.

In particular embodiments of the compositions and methods provided herein, immune cells comprising the two receptor system described herein are used to treat Mesothelin (MSLN) positive cancers. This includes mesothelioma cancer, ovarian cancer, cervical cancer, colorectal cancer, esophageal cancer, head and neck cancer, kidney cancer, uterine cancer, gastric cancer, pancreatic cancer, lung cancer, colorectal cancer, or cholangiocarcinoma. In some embodiments, the cancer has relapsed in a subject. In some embodiments, the cancer is refractory to one or more prior administered anticancer therapies. In some embodiments, the cancer is metastatic. In the case of MSLN-positive cancers, the target antigen of the activator receptor is MSLN, or a peptide antigen thereof, in a complex with a major histocompatibility complex class I (MHC-I). MSLN is expressed in normal adipose, fallopian tube, lung and salivary gland tissues, among others (FIG. 2). Because of its expression in certain tumors, MSLN is an attractive tumor-specific antigen that could mediate selective killing of MSLN+ tumors if these cancer cells could be specifically targeted with an appropriate therapeutic. However, normal MSLN expression in non-cancer (non-target) cells has prevented the effective use of MSLN for targeted therapies such as adoptive cell therapies. By pairing an MSLN activator receptor with an inhibitory receptor, the methods provided herein increase the specificity of adoptive cell therapies and decrease harmful effects associated with these therapies, such as dose-limited toxicity.

In some embodiments, the ligand for the activator is a MSLN peptide complexed with MHC class I. In the methods described herein, this MSLN targeted activator receptor is paired with an inhibitory receptor, which increases the safety window of the activator by blocking its cytolytic effect on normal MSLN-positive tissues. However, the activator receptor still directs the targeted killing of tumor cells by immune cells comprising the two-receptor system, as the tumor cells do not express the ligand for the inhibitor, or blocker, receptor. The target for the second, inhibitory receptor is expressed by MSLN positive tissues such as lung, mesothelium and adipose tissues, but not in cancer cells, and the inhibitory receptor recognizes this "non-target antigen" as an inhibitory stimulus. An exemplary target for the second inhibitory receptor is expressed by lung tissue, and is lost from MSLN positive cancer cells due to loss of heterozygosity (LOH) or other mechanisms, leaving a single allelic form in cancer cells that can be distinguished from other alleles via an allele-specific ligand binding domain on the inhibitory receptor. Exemplary targets of the inhibitory receptor include, but are not limited to, Major Histocompatibility Complex (MHC) proteins such as human leukocyte antigen A (HLA-A). HLA-B, HLA-C, and other HLAs. HLAs are encoding by variant genes, such as HLA-A*01, HLA-A*02, HLA-A*03, HLA-C*07, and others, which can be lost from MSLN positive cancer cells through loss of heterozygosity. Alternatively, further exemplary targets of the inhibitory receptor include, but are not limited to, intercellular adhesion molecule 1 (ICAM1), catechol-O-methyltransferase (COMT) and C—X—C motif chemokine ligand 16 (CXCL16). Each of these has a common nonsynonymous variant form, with the amino-acid alteration in its extracellular domain accessible to antibodies, which can be used as a inhibitory receptor, or blocker receptor target for a cellular integrator designed to safely treat patients with MSLN positive cancers with engineered T cells activated by an activator receptor such as a MSLN or MSLN pMHC responsive activator receptor.

The compositions and methods of the disclosure can reduce or eliminate dose-limiting toxicity (DLT) caused by expression of MSLN on normal tissue. The disclosure provides methods of targeting MSLN in cancer cells to treat MSLN positive cancers using adoptive cell therapies by adding a second inhibitory receptor that blocks activation of the adoptive immune cells in the presence of a second ligand (a ligand other than MSLN, termed the non-target antigen or alternatively, blocker antigen). Using the compositions and methods described herein, tumor cells that express MSLN are attacked by the adoptive cells, such as immune cells, expressing the two receptors because these tumor cells express only the activator ligand, MSLN. In contrast, normal cells that express MSLN plus the non-target antigen are protected from the adoptive immune cells. The inhibitory receptor response to the non-target antigen on normal cells prevents activation of immune cells by the MSLN-targeted activator receptor. This dual-targeting approach creates the therapeutic window that will allow a MSLN-directed cell therapy to be dosed safely and effectively in MSLN-positive cancer patients.

The disclosure provides methods and compositions that allow the use of potent MSLN CAR and TCRs that induce on-target toxicity, and renders these MSLN targeted receptors useful as a therapeutic by mitigating their toxicity.

In variations, the compositions and methods described herein may be used to kill target cells and/or treat subjects in which expression of the non-target antigen is partially or completely decreased by causes other than loss of heterozygosity, including but not limited to partial gene deletion, epigenetic silencing, and point mutations or truncating mutations in the sequence encoding the non-target antigen.

Definitions

Prior to setting forth this disclosure in more detail, it may be helpful to an understanding thereof to provide definitions of certain terms to be used herein.

Unless defined otherwise, all technical and scientific terms used herein have the same meaning as commonly understood by those of ordinary skill in the art to which the disclosure belongs. Although any methods and materials similar or equivalent to those described herein can be used in the practice or testing of particular embodiments, preferred embodiments of compositions, methods and materials are described herein. For the purposes of the present disclosure, the following terms are defined below. Additional definitions are set forth throughout this disclosure.

As used herein, the term "about" or "approximately" refers to a quantity, level, value, number, frequency, percentage, dimension, size, amount, weight or length that varies by as much as 15%, 10%, 9%, 8%, 7%, 6%, 5%, 4%, 3%, 2% or 1% to a reference quantity, level, value, number, frequency, percentage, dimension, size, amount, weight or length. In one embodiment, the term "about" or "approximately" refers to a range of quantity, level, value, number, frequency, percentage, dimension, size, amount, weight or length ±15%, ±10%, ±9%, ±8%, ±7%, ±6%, ±5%, ±4%, ±3%, ±2%, or ±1% about a reference quantity, level, value, number, frequency, percentage, dimension, size, amount, weight or length.

As used herein, the term "isolated" means material that is substantially or essentially free from components that normally accompany it in its native state. In particular embodiments, the term "obtained" or "derived" is used synonymously with isolated.

The terms "subject," "patient" and "individual" are used interchangeably herein to refer to a vertebrate, preferably a mammal, more preferably a human. Tissues, cells, and their progeny of a biological entity obtained in vivo or cultured in vitro are also encompassed. A "subject," "patient" or "individual" as used herein, includes any animal that exhibits pain that can be treated with the vectors, compositions, and methods contemplated herein. Suitable subjects (e.g., patients) include laboratory animals (such as mouse, rat, rabbit, or guinea pig), farm animals, and domestic animals or pets (such as a cat or dog). Non-human primates and, preferably, human patients, are included.

As used herein "treatment" or "treating," includes any beneficial or desirable effect, and may include even minimal improvement in symptoms. "Treatment" does not necessarily indicate complete eradication or cure of the disease or condition, or associated symptoms thereof.

As used herein, "prevent," and similar words such as "prevented," "preventing" etc., indicate an approach for preventing, inhibiting, or reducing the likelihood of a symptom of disease. It also refers to delaying the onset or recurrence of a disease or condition or delaying the occurrence or recurrence of the symptoms of a disease. As used herein, "prevention" and similar words also includes reducing the intensity, effect, symptoms and/or burden of disease prior to onset or recurrence.

As used herein, the term "amount" refers to "an amount effective" or "an effective amount" of a virus to achieve a beneficial or desired prophylactic or therapeutic result, including clinical results.

A "therapeutically effective amount" of a virus or cell may vary according to factors such as the disease state, age, sex, and weight of the individual, and the ability of the virus or cell to elicit a desired response in the individual. A therapeutically effective amount is also one in which any toxic or detrimental effects of the virus or cell are outweighed by the therapeutically beneficial effects. The term "therapeutically effective amount" includes an amount that is effective to "treat" a subject (e.g., a patient).

An "increased" or "enhanced" amount of a physiological response, e.g., electrophysiological activity or cellular activity, is typically a "statistically significant" amount, and may include an increase that is 1.1, 1.2, 1.5, 2, 3, 4, 5, 6, 7, 8, 9, 10, 15, 20, 30 or more times (e.g., 500, 1000 times) (including all integers and decimal points in between and above 1, e.g., 1.5, 1.6, 1.7. 1.8, etc.) the level of activity in an untreated cell.

A "decreased" or "reduced" amount of a physiological response, e.g., electrophysiological activity or cellular activity, is typically a "statistically significant" amount, and may include a decrease that is 1.1, 1.2, 1.5, 2, 3, 4, 5, 6, 7, 8, 9, 10, 15, 20, 30 or more times (e.g., 500, 1000 times) (including all integers and decimal points in between and above 1, e.g., 1.5, 1.6, 1.7. 1.8, etc.) the level of activity in an untreated cell.

By "maintain," or "preserve," or "maintenance," or "no change," or "no substantial change," or "no substantial decrease" refers generally to a physiological response that is comparable to a response caused by either vehicle, or a control molecule/composition. A comparable response is one that is not significantly different or measurable different from the reference response.

In general, "sequence identity" or "sequence homology" refers to an exact nucleotide-to-nucleotide or amino acid-to-amino acid correspondence of two polynucleotides or polypeptide sequences, respectively. Typically, techniques for determining sequence identity include determining the nucleotide sequence of a polynucleotide and/or determining the amino acid sequence encoded thereby, and comparing these sequences to a second nucleotide or amino acid sequence. Two or more sequences (polynucleotide or amino acid) can be compared by determining their "percent identity." The percent identity of two sequences, whether nucleic acid or amino acid sequences, is the number of exact matches between two aligned sequences divided by the length of the shorter sequences and multiplied by 100. Percent identity may also be determined, for example, by comparing sequence information using the advanced BLAST computer program, including version 2.2.9, available from the National Institutes of Health. The BLAST program is based on the alignment method of Karlin and Altschul, Proc. Natl. Acad. Sci. USA 87:2264-2268 (1990) and as discussed in Altschul, et al., J. Mol. Biol. 215:403-410 (1990); Karlin And Altschul, Proc. Natl. Acad. Sci. USA 90:5873-5877 (1993); and Altschul et al., Nucleic Acids Res. 25:3389-3402 (1997). Briefly, the BLAST program defines identity as the number of identical aligned symbols (generally nucleotides or amino acids), divided by the total number of symbols in the shorter of the two sequences. The program may be used to determine percent identity over the entire length of the proteins being compared. Default parameters are provided to optimize searches with short query sequences in, for example, with the blastp program. The program also allows use of an SEG filter to mask-off segments of the query sequences as determined by the SEG program of Wootton and Federhen, Computers and Chemistry 17:149-163 (1993). Ranges of desired degrees of sequence identity are approximately 80% to 100% and integer values therebetween. Typically, the percent identities between a disclosed sequence and a claimed sequence are at least 80%, at least 85%, at least 90%, at least 95%, or at least 98%.

As used herein, a "polynucleotide system" refers to one or more polynucleotides. The one or more polynucleotides may be designed to work in concert for a particular application, or to produce a desired transformed cell.

The term "exogenous" is used herein to refer to any molecule, including nucleic acids, protein or peptides, small molecular compounds, and the like that originate from outside the organism. In contrast, the term "endogenous" refers to any molecule that originates from inside the organism (i.e., naturally produced by the organism).

The term "MOI" is used herein to refer to multiplicity of infection, which is the ratio of agents (e.g. viral particles) to infection targets (e.g. cells).

In the present description, any concentration range, percentage range, ratio range, or integer range is to be understood to include the value of any integer within the recited range and, when appropriate, fractions thereof (such as one tenth and one hundredth of an integer), unless otherwise indicated. The term "about", when immediately preceding a number or numeral, means that the number or numeral ranges plus or minus 10%.

As used herein, a "target cell" refers to cell that is targeted by an adoptive cell therapy. For example, a target cell can be cancer cell, which can be killed by the transplanted T cells of the adoptive cell therapy. Target cells of the disclosure express a target antigen, as described herein, and do not express a non-target antigen.

As used herein, a "non-target cell" refers to cell that is not targeted by an adoptive cell therapy. For example, in an adoptive cell targeting cancer cells, normal, healthy, non-cancerous cells are non-target cells. Some, or all, non-target cells in a subject may express both the target antigen and the non-target antigen. Non-target cells in a subject may express the non-target antigen irrespective of whether or not these cells also express the target antigen.

As used herein, a "non-target allelic variant" refers to an allele of a gene whose product is expressed by non-target cells, but is not expressed by target cells. For example, a non-target allelic variant is an allele of a gene that is expressed by normal, non-cancer cells of subject, but not expressed by cancer cells of the subject. The expression of the non-target allelic variant can be lost in the cancer cells by any mechanism, including, but not limited to, loss of heterozygosity, mutation, or epigenetic modification of the gene encoding the non-target allelic variant.

As used herein, "specific to" or "specifically binds to" when used with respect to a ligand binding domain, such as an antigen binding domain, refers to a ligand binding domain that has a high specificity for a named target. Antibody specificity can viewed as a measure of the goodness of fit between the ligand binding domain and the corresponding ligand, or the ability of the ligand binding domain to discriminate between similar or even dissimilar ligands. In comparison with specificity, affinity is a measure of the strength of the binding between the ligand binding domain and ligand, such that a low-affinity ligand binding domain binds weakly and high-affinity ligand binding domain binds firmly. A ligand binding domain that is specific to a target allele is one that can discriminate between different alleles of a gene. For example, a ligand binding domain that is specific to HLA-A*02 will not bind, or bind only weakly to, other HLA-A alleles such as HLA-A*01 or HLA-A*03. The person of skill in the art will appreciate that a ligand binding domain can be said to be specific to a particular target, and yet still have low levels of binding to one or more additional targets that do not affect its function in the receptor systems described herein.

As used herein, a "target antigen," whether referred to using the term antigen or the name of a specific antigen, refers to an antigen expressed by a target cell, such as a cancer cell. Expression of target antigen is not limited to target cells. Target antigens may be expressed by both cancer cells and normal, non-cancer cells in a subject.

As used herein, a "non-target antigen" (or "blocker antigen") whether referred to using the term antigen or the name of a specific antigen, refers to an antigen that is expressed by normal, non-cancer cells and is not expressed in cancer cells. This difference in expression allows the inhibitory receptor to inhibit immune cell activation in the presence of non-target cells, but not in the presence of target cells.

Polymorphism refers to the presence of two or more variants of a nucleotide sequence in a population. A polymorphism may comprise one or more base changes, an insertion, a repeat, or a deletion. A polymorphism includes e.g. a simple sequence repeat (SSR) and a single nucleotide polymorphism (SNP), which is a variation, occurring when a single nucleotide of adenine (A), thymine (T), cytosine (C) or guanine (G) is altered.

As used herein, "affinity" refers to strength of binding of a ligand to a single ligand binding site on a receptor, for example an antigen for the antigen binding domain of any of the receptors described herein. Ligand binding domains can have a weaker interaction (low affinity) with their ligand, or a stronger interaction (high affinity).

Kd, or dissociation constant, is a type of equilibrium constant that measures the propensity of a larger object to separate reversibly into smaller components, such as, for example, when a macromolecular complex comprising receptor and its cognate ligand separates into the ligand and the receptor. When the Kd is high, it means that a high concentration of ligand is need to occupy the receptor, and the affinity of the receptor for the ligand is low. Conversely, a low Kd means that the ligand has a high affinity for the receptor.

As used herein, a receptor that is "responsive" or "responsive to" refers to a receptor comprising an intracellular domain, that when bound by a ligand (i.e. antigen) generates a signal corresponding to the known function of the intracellular domain. An activator receptor bound to a target antigen can generate a signal that causes activation of an immune cell expressing the activator receptor. An inhibitory receptor bound to a non-target antigen can generate an inhibitory signal that prevents or reduces an activation of an immune cell expressing the activator receptor. Responsiveness of receptors, and their ability to activate or inhibit immune cells expressing the receptors, can be assayed by any means known in the art and described herein, including, but not limited to, reporter assays and cytotoxicity assays.

As used herein, "activation" of an immune cell or an immune cell that is "activated" refers to an immune cell that can carry out one or more functions characteristic of an immune response. These functions include proliferation, release of cytokines, and cytotoxicity, i.e. killing of a target cell. Activated immune cells express markers that will be apparent to persons of skill in the art. For example, activated T cells can express one or more of CD69, CD71, CD25 and I-ILA-DR. An immune cell expressing an activator receptor (e.g. a MSLN CAR) can be activated by the activator receptor when it becomes responsive to the binding of the receptor to a target antigen (e.g. MSLN) expressed by the target cell. A "target antigen" can also be referred to an "activator antigen" and may be isolated or expressed by a target cell. Activation of an immune cell expressing an inhibitory receptor can be prevented when the inhibitory receptor becomes responsive to a non-target antigen (e.g. HLA-A*02), even when the activator receptor is bound to the target activator ligand. A "non-target antigen" can also be referred to as an "inhibitory ligand" or a "blocker", and may be isolated or expressed by a target cell.

Receptor expression on an immune cell can be verified by assays that report the presence of the activator receptors and inhibitory receptors described herein. For example, a population of immune cells can be stained with a labeled molecule (e.g. a fluorophore labeled receptor-specific antibody or a fluorophore-labeled receptor-specific ligand), and quantified using fluorescence activated cell sorting (FACS) flow cytometry. This method allows a percentage of immune cells in a population of immune cells to be characterized as expressing an activator receptor, an inhibitory receptor, or both receptors. The ratio of activator receptor and inhibitory receptors expressed by the immune cells described herein can be determined by, for example, digital droplet PCR. These approaches can be used to characterize the population of cells for the production and manufacturing of the immune cells, pharmaceutical compositions, and kits described herein. For the immune cells, pharmaceutical compositions, and kits described herein, it is understood that a suitable percentage of immune cells expressing both an activator receptor and an inhibitory receptor is determined specifically for the methods described herein. For example, a suitable percentage of immune cells expressing both an activator receptor and in inhibitory receptor can be at least 50%, at least 55%, at least 60%, at least 65%, at least 70%, at least 75%, at least 80%, at least 85%, at least 90%, or at least 95%. As a further example, between 50% and 99%, between 60% and 95%, between 65% and 95%, between 65% and 90%, between 70% and 90%, between 75% and 90%, between 75% and 85%, between 80% and 99%, between 85% and 99%, between 90% and 99% or between 95% and 99% of immune cells can express both the activator receptor and the inhibitory receptor. For example, a suitable ratio of activator receptor and inhibitory receptor in an immune cell can be about 5:1, about 4:1, about 3:1, about 2:1, about 1:1, about 1:2, about 1:3, about 1:4, or about 1:5. It is understood that purification, enrichment, and/or depletion steps can be used on populations of immune cells to meet suitable values for the immune cells, pharmaceutical compositions, and kits described herein.

A responsive receptor expressed by the immune cells described herein can be verified by assays that measure the generation of a signal expected to be generated by the intracellular domain of the receptor. Reporter cell lines, such as Jurkat-Luciferase NFAT cells (Jurkat cells), can be used to characterize a responsive receptor. Jurkat cells are derived from T cells and comprise a stably integrated nuclear factor of activated T-cells (NFAT)-inducible luciferase reporter system. NFAT is a family of transcription factors required for immune cell activation, whose activation can be used as a signaling marker for T cell activation. Jurkat cells can be transduced or transfected with the activator receptors and/or inhibitory receptors described herein. The activator receptor is responsive to the binding of a ligand if the Jurkat cell expresses a luciferase reporter gene, and the level of responsiveness can be determined by the level of reporter gene expression. The presence of luciferase can be determined using any known luciferase detection reagent, such as luciferin. An inhibitory receptor is responsive to the binding of a ligand if, when co-expressed with an activator receptor in Jurkat cells, it prevents a normally responsive immune cell from expressing luciferase in response to the activator receptor. For example, the responsiveness of an inhibitory receptor can be determined and quantified in a Jurkat cell expressing both an activator and an inhibitor by observing the following: 1) the Jurkat cell expresses luciferase in the presence of activator receptor ligand and absence of inhibitory receptor ligand; and 2) luciferase expression in the Jurkat cell is reduced or eliminated in the presence of both an activator receptor ligand and an inhibitory receptor ligand. This approach can be used to determine the sensitivity, potency, and selectivity of activator receptors and specific pairs of activator receptors and inhibitory receptors. The sensitivity, potency, and selectivity can be quantified by EC50 or IC50 values using dose-response experiments, where an activator receptor ligand and/or inhibitory receptor ligand is titrated into a culture of Jurkat cells expressing an activator receptor or a specific pair of activator and inhibitory receptors. Alternatively, the EC50 and IC50 values can be determined in a co-culture of immune cells (e.g. Jurkat cells or primary immune cells) expressing an activator receptor or a specific pair of activator and inhibitory receptors and target cells expressing an increasing amount of an activator ligand or inhibitor ligand. An increasing amount of activator ligand or inhibitor ligand can be accomplished in the target cell by, for example, titration of activator ligand or inhibitor ligand encoding mRNA into target cells, or use of target cells that naturally express different levels of the target ligands. Exemplary suitable EC50 and IC50 values for the activator and inhibitory receptors as determined used target cells expressing varying amounts of the target and non-target ligands include an EC50 of 10 transcripts per million (TPM) or less for the activator receptor, for example an EC50 of between 2-10 TPM, and an IC50 of 25 TPM or less for the inhibitory receptor, for example an IC50 of 5-21 TPM.

Activation of the immune cells described herein that express an activator receptor or specific pairs of activator and inhibitory receptors can be further determined by assays that measure the viability of a target cell following co-incubation with said immune cells. The immune cells, sometimes referred to as effector cells, are co-incubated with target cells that express an activator receptor ligand, an inhibitory receptor ligand, or both an activator and inhibitory receptor ligand. Following co-incubation, viability of the target cell is measured using any method to measure viability in a cell culture. For example, viability can be determined using a mitochondrial function assay that uses a tetrazolium salt substrate to measure active mitochondrial enzymes. Viability can also be determined using imaging based methods. Target cells can express a fluorescent protein, such as green fluorescent protein or red fluorescent protein. Reduction in total cell fluorescence indicates a reduction in viability of the target cell. A reduction in viability of the target cell following incubation with immune cells expressing an activator receptor or a specific pair of activator and inhibitory receptors is interpreted as target cell-mediated activation of the immune cell. A measure of the selectivity of the immune cells can also be determined using this approach. The immune cell expressing a pair of activator and inhibitory receptors is selective if the following is observed: 1) viability is reduced in target cells expressing the activator receptor ligand but not the inhibitory receptor ligand; 2) viability is not reduced in target cells expressing both an activator receptor ligand and an inhibitory receptor ligand. From these measurements, a "specific killing" value can be derived that quantifies the percentage of immune cell activation based on the reduction in viability of target cell as a percentage of a negative control (immune cells that do not express an activator receptor). Further, from these measurements a "selectivity ratio" value can be derived that represents the ratio of the specific killing observed in target cells expressing an activator receptor ligand in the absence of inhibitory receptor ligand to the specific killing observed in target cells expressing both an activator receptor ligand and an inhibitory receptor ligand. This approach can be used to characterize the population of cells for the production and manufacturing of the immune cells, pharmaceutical compositions, and kits described herein. A suitable specific killing value for the immune cells, pharmaceutical compositions, and kits can be, for example, the following criteria: 1) at least 40%, at least 50%, at least 60%, at least 70%, at least 80%, at least 90%, at least 95%, at least 97% or at least 99% specific killing following a 48 hour co-incubation of immune cells and target cells expressing activator receptor ligand in the absence of inhibitory receptor ligand; and 2) less than or equal to 40%, less than or equal to 35%, less than or equal to 30%, less than or equal to 25%, less than or equal to 20%, less than or equal to 15%, less than or equal to 10%, less than or equal to 5%, less than or equal to 3% or less than or equal to 1% specific killing of target cell expressing both an activator receptor ligand and an inhibitory receptor ligand.

As a further example, a suitable specific killing value for the immune cells, pharmaceutical compositions and kits can be the following criteria: 1) between 30% and 99%, between 40% and 99%, between 50% and 99%, between 55% and 95%, between 60% and 95%, between 60% and 90%, between 50% and 80%, between 50% and 70% or between 50% and 60% of target cells expressing the activator ligand but not the inhibitor ligand are killed; and 2), between 1% and 40%, between 3% and 40%, between 5% and 40%, between 5% and 30%, between 10% and 30%, between 15% and 30% or between 5% and 20% of target cells expressing the activator ligand and the inhibitor ligand are killed. As a still further example, a suitable specific killing value for the immune cells, pharmaceutical compositions, and kits can be, for example, the following criteria: 1) at least 50% specific killing following a 48 hour co-incubation of immune cells and target cells expressing activator receptor ligand in the absence of inhibitory receptor ligand; and 2) less than or equal to 20% specific killing of target cell expressing both an activator receptor ligand and an inhibitory receptor ligand. As a further example, the immune cells are capable of killing at least 30%, at least 40%, at least 50%, at least 60%, at least 70%, at least 80%, at least 90%, at least 95%, at least 97% or at least 99% of target cells expressing the activator ligand and not the inhibitor ligand over a period of 6 hours, 12 hours, 18 hours, 24 hours, 30 hours, 36 hours, 42 hours, 48 hours, 54 hours, or 60 hours, while killing less than 40%, less than 30%, less than 20%, less than 10%, less than 5%, less than 3% or less than 1% of target cells expressing the activator and inhibitor ligands over the same time period.

A suitable specific killing value of the target cell expressing an activator ligand in the absence of an inhibitory ligand value for the immune cells, pharmaceutical compositions, and kits can be, for example, at least about 50% to at least about 95%. A suitable specific killing value of the target cell expressing an activator ligand in the absence of an inhibitory ligand value for the immune cells, pharmaceutical compositions, and kits can be, for example, at least about 50%, at least about 55%, at least about 60%, at least about 65%, at least about 70%, at least about 75%, at least about 80%, at least about 85%, at least about 90%, or at least about 95%. A suitable specific killing value of the target cell expressing an activator ligand in the absence of an inhibitory ligand value for the immune cells, pharmaceutical compositions, and kits can be, for example, at most about 50%, at most about 55%, at most about 60%, at most about 65%, at most about 70%, at most about 75%, at most about 80%, at most about 85%, at most about 90%, or at most about 95%. A suitable specific killing value of target cells expressing both an activator receptor ligand and an inhibitory receptor ligand for the immune cells, pharmaceutical compositions, and kits can be can be less than about 50%, less than about 45%, less than about 40%, less than about 35%, less than about 30%, less than about 25%, less than about 20%, less than about 15%, less than about 10%, or less than about 5%. The suitable specific killing value for the immune cells, pharmaceutical compositions, and kits can be can be determined following about 6 hours, about 12 hours, about 18 hours, about 24, about 30 hours, about 36 hours, about 42 hours, about 48 hours, about 54 hours, about 60 hours, about 66 hours, or about 72 hours of co-incubation of immune cells with target cells.

A suitable specific killing value of the target cell expressing an activator ligand in the absence of an inhibitory ligand value for the immune cells, pharmaceutical compositions, and kits can be, for example, at least about 50% to at least about 95%. A suitable specific killing value of the target cell expressing an activator ligand in the absence of an inhibitory ligand value for the immune cells, pharmaceutical compositions, and kits can be, for example, at least about 50%, at least about 55%, at least about 60%, at least about 65%, at least about 70%, at least about 75%, at least about 80%, at least about 85%, at least about 90%, or at least about 95%. A suitable specific killing value of the target cell expressing an activator ligand in the absence of an inhibitory ligand value for the immune cells, pharmaceutical compositions, and kits can be, for example, at most about 50%, at most about 55%, at most about 60%, at most about 65%, at most about 70%, at most about 75%, at most about 80%, at most about 85%, at most about 90%, or at most about 95%. A suitable specific killing value of target cells expressing both an activator receptor ligand and an inhibitory receptor ligand for the immune cells, pharmaceutical compositions, and kits can be can be less than about 50%, less than about 45%, less than about 40%, less than about 35%, less than about 30%, less than about 25%, less than about 20%, less than about 15%, less than about 10%, or less than about 5%. The suitable specific killing value for the immune cells, pharmaceutical compositions, and kits can be can be determined following about 6 hours, about 12 hours, about 18 hours, about 24, about 30 hours, about 36 hours, about 42 hours, about 48 hours, about 54 hours, about 60 hours, about 66 hours, or about 72 hours of co-incubation of immune cells with target cells.

As used herein, the term "functional variant" refers to a protein that has one or more amino-acid substitutions, insertions, or deletions as compared to a parental protein, and which retains one or more desired activities of the parental protein. A functional variant may be a fragment of the protein (i.e. a variant having N- and/or C-terminal deletions) that retain the one or more desired activities of the parental protein.

All publications and patents mentioned herein are hereby incorporated by reference in their entirety as if each individual publication or patent was specifically and individually indicated to be incorporated by reference. In case of conflict, the present application, including any definitions herein, will control. However, mention of any reference, article, publication, patent, patent publication, and patent application cited herein is not, and should not be taken as an acknowledgment, or any form of suggestion, that they constitute valid prior art or form part of the common general knowledge in any country in the world.

Activator Receptors

The disclosure provides a first receptor, comprising a first extracellular ligand binding domain specific to a target antigen comprising a cancer cell-specific antigen, or a peptide antigen thereof in a complex with a major histocompatibility complex class I (MHC-I). The first receptor is an activator receptor, and mediates activation of an immune cell expressing the first receptor upon binding of the target antigen by the extracellular ligand binding domain of the first receptor. The first receptor is responsive to a target antigen (i.e. activator ligand). For example, when a target antigen binds to or contacts the first receptor, the first receptor is responsive and activates an immune cell expressing the first receptor upon binding of the target antigen by the extracellular ligand binding domain of the first receptor. In some embodiments, the first receptor is a chimeric antigen receptor (CAR). In some embodiments, the first receptor is a T cell receptor (TCR).

In some embodiments, the first receptor is humanized. As used herein, "humanized" refers to the replacement of a sequence or a subsequence in a transgene that has been isolated or derived from a non-human species with a homologous, or functionally equivalent, human sequence. For example, a humanized antibody can be created by grafting mouse CDRs into human framework sequences, followed by back substitution of certain human framework residues for the corresponding mouse residues from the source antibody.

Activator Targets

In some embodiments, the target antigen for the first receptor is a cancer cell specific antigen. Any cell surface molecule expressed by the target cancer cells may be a suitable target antigen for the first receptor ligand binding domain. For example, a cell adhesion molecule, a cell-cell signaling molecule, an extracellular domain, a molecule involved in chemotaxis, a glycoprotein, a G protein-coupled receptor, a transmembrane, a receptor for a neurotransmitter or a voltage gated ion channel can be used as a target antigen.

In some embodiments, the target antigen is a peptide antigen of a cancer cell-specific antigen in a complex with a major histocompatibility complex class I (MHC-I). Any molecule expressed by the target cancer cells and presented by the major histocompatibility complex class I (MHC-I) on the cancer cell surface as a peptide antigen (pMHC) may be a suitable target antigen for the first receptor extracellular ligand binding domain.

In some embodiments, the cancer cell-specific antigen is Mesothelin (MSLN), or a peptide antigen thereof in a complex with a major histocompatibility complex class I (MHC-I).

The major histocompatibility complex class I (MHC-I) is a protein complex that displays antigens to cells of the immune system, triggering an immune response. The Human Leukocyte Antigens (HLAs) corresponding to MHC-I are HLA-A, HLA-B and HLA-C.

Cancer cell-specific pMHC antigens comprising any of HLA-A, HLA-B, HLA-C, HLA-E, HLA-F or HLA-G are envisaged as within the scope of the disclosure. In some embodiments, the cancer cell-specific antigen comprises HLA-A. HLA-A receptors are heterodimers comprising a heavy chain and smaller β chain. The α chain is encoded by a variant of HLA-A, while the β chain (β2-microglobulin) is an invariant. There are several thousand variant HLA-A genes, all of which fall within the scope of the instant disclosure. In some embodiments, the MHC-I comprises a human leukocyte antigen A*02 allele (HLA-A*02).

In some embodiments, the cancer cell-specific antigen comprises HLA-B. Hundreds of versions (alleles) of the HLA-B gene are known, each of which is given a particular number (such as HLA-B*27).

In some embodiments, the cancer cell-specific antigen comprises HLA-C. HLA-C belongs to the HLA class I heavy chain paralogues. This class I molecule is a heterodimer consisting of a heavy chain and a light chain (beta-2 microglobulin). Over one hundred HLA-C alleles are known in the art.

In some embodiments, the cancer cell-specific antigen is an ovarian cancer antigen, a pancreatic cancer antigen, a lung cancer antigen, a colorectal cancer antigen or a mesothelioma antigen. In some embodiments, the cancer cell-specific antigen is a colorectal cancer antigen. In some embodiments, the cancer cell-specific antigen is MSLN or a peptide antigen thereof.

In some embodiments, the cancer cell-specific antigen is MSLN, or a peptide antigen thereof in a complex with a major histocompatibility complex class I (MHC-I). MSLN is a 40 KDa protein that is normally expressed in mesothelial cells, as well as lung, fallopian tube, salivary gland and adipose tissues (FIG. 2). MSLN is expressed in multiple human tumor types, including mesothelioma cancer, ovarian cancer, cervical cancer, colorectal cancer, esophageal cancer, head and neck cancer, kidney cancer, uterine cancer, gastric cancer, pancreatic cancer, lung cancer, colorectal cancer, or cholangiocarcinoma. In some embodiments, the cancer has relapsed in a subject. In some embodiments, the cancer is refractory to one or more prior administered anticancer therapies. In some embodiments, the cancer is metastatic.

All isoforms of MSLN are envisaged as cancer cell-specific antigens of the disclosure. MSLN isoform 1 preprotein is described in NCBI record number NP 005814.2, the contents of which are incorporated by reference herein. In some embodiments, MSLN comprises an amino acid sequence of:

```
                                         (SEQ ID NO: 1)
  1  MALPTARPLL GSCGTPALGS LLFLLFSLGW VQPSRTLAGE

TGQEAAPLDG VLANPPNISS

61  LSPRQLLGFP CAEVSGLSTE RVRELAVALA QKNVKLSTEQ

LRCLAHRLSE PPEDLDALPL

121  DLLLFLNPDA FSGPQACTRF FSRITKANVD LLPRGAPERQ

RLLPAALACW GVRGSLLSEA

181  DVRALGGLAC DLPGRFVAES AEVLLPRLVS CPGPLDQDQQ

EAARAALQGG GPPYGPPSTW

241  SVSTMDALRG LLPVLGQPII RSIPQGIVAA WRQRSSRDPS

WRQPERTILR PRFRREVEKT

301  ACPSGKKARE IDESLIFYKK WELEACVDAA LLATQMDRVN

AIPFTYEQLD VLKHKLDELY

361  PQGYPESVIQ HLGYLFLKMS PEDIRKWNVT SLETLKALLE

VNKGHEMSPQ VATLIDRFVK

421  GRGQLDKDTL DTLTAFYPGY LCSLSPEELS SVPPSSIWAV

RPQDLDTCDP RQLDVLYPKA

481  RLAFQNMNGS EYFVKIQSFL GGAPTEDLKA LSQQNVSMDL

ATFMKLRTDA VLPLTVAEVQ

541  KLLGPHVEGL KAEERHRPVR DWILRQRQDD LDTLGLGLQG

GIPNGYLVLD LSMQEALSGT

601  PCLLGPGPVL TVLALLLAST LA.
```

In some embodiments, MSLN comprises a sequence that shares at least 80%, at least 85%, at least 90%, at least 95%, at least 96%, at least 97%, at least 98%, or at least 99% identity to SEQ ID NO: 1.

MSLN isoform 2 preprotein is described in NCBI record number NP 037536.2, the contents of which are incorporated by reference herein. In some embodiments, MSLN comprises an amino acid sequence of:

```
                                         (SEQ ID NO: 2)
  1  MALPTARPLL GSCGTPALGS LLFLLFSLGW VQPSRTLAGE

TGQEAAPLDG VLANPPNISS

61  LSPRQLLGFP CAEVSGLSTE RVRELAVALA QKNVKLSTEQ

LRCLAHRLSE PPEDLDALPL

121  DLLLFLNPDA FSGPQACTRF FSRITKANVD LLPRGAPERQ

RLLPAALACW GVRGSLLSEA

181  DVRALGGLAC DLPGRFVAES AEVLLPRLVS CPGPLDQDQQ

EAARAALQGG GPPYGPPSTW

241  SVSTMDALRG LLPVLGQPII RSIPQGIVAA WRQRSSRDPS

WRQPERTILR PRFRREVEKT

301  ACPSGKKARE IDESLIFYKK WELEACVDAA LLATQMDRVN

AIPFTYEQLD VLKHKLDELY
```

-continued

```
361  PQGYPESVIQ HLGYLFLKMS PEDIRKWNVT SLETLKALLE

VNKGHEMSPQ APRRPLPQVA

421  TLIDRFVKGR GQLDKDTLDT LTAFYPGYLC SLSPEELSSV

PPSSIWAVRP QDLDTCDPRQ

481  LDVLYPKARL AFQNMNGSEY FVKIQSFLGG APTEDLKALS

QQNVSMDLAT FMKLRTDAVL

541  PLTVAEVQKL LGPHVEGLKA EERHRPVRDW ILRQRQDDLD

TLGLGLQGGI PNGYLVLDLS

601  MQEALSGTPC LLGPGPVLTV LALLLASTLA.
```

In some embodiments, MSLN comprises a sequence that shares at least 80%, at least 85%, at least 90%, at least 95%, at least 96%, at least 97%, at least 98%, or at least 99% identity to SEQ ID NO: 2.

In some embodiments, the cancer cell-specific antigen is a peptide antigen derived from MSLN. In some embodiments, the peptide antigen is comprises a sequence having at least 80%, at least 85%, at least 90%, at least 95%, at least 96%, at least 97%, at least 98%, or at least 99% identity to a subsequence of SEQ ID NO: 1 and/or SEQ ID NO: 2. In some embodiments, the peptide antigen comprises a sequence identical to a subsequence of SEQ ID NO: 1 and/or SEQ ID NO: 2.

Extracellular Ligand Binding Domain

The disclosure provides a first receptor, comprising a first extracellular ligand binding domain specific to a target antigen. In some embodiments, the target antigen comprises a cancer cell-specific antigen.

In some embodiments, the cancer cell-specific antigen is MSLN or a MSLN-derived peptide antigen complexed with MHC-I, and the ligand binding domain of the first receptor recognizes and binds to the MSLN antigen.

Any type of ligand binding domain that can regulate the activity of a receptor in a ligand dependent manner is envisaged as within the scope of the instant disclosure. In some embodiments, the ligand binding domain is an antigen binding domain. Exemplary antigen binding domains include, inter alia, scFv, SdAb, VP-only domains, and TCR antigen binding domains derived from the TCR α and β chain variable domains.

Any type of antigen binding domain is envisaged as within the scope of the instant disclosure.

For example, the first extracellular ligand binding domain may be part of a contiguous polypeptide chain including, for example, a VP-only domain, a single domain antibody fragment (sdAb) or heavy chain antibodies HCAb, a single chain antibody (scFv) derived from a murine, humanized or human antibodies (Harlow et al., 1999, In: Using Antibodies: A Laboratory Manual, Cold Spring Harbor Laboratory Press, N.Y.; Harlow et al., 1989, In: Antibodies: A Laboratory Manual, Cold Spring Harbor, N.Y.; Houston et al., 1988, Proc. Natl. Acad. Sci. USA 85:5879-5883; Bird et al., 1988, Science 242:423-426). In some aspects, the first extracellular ligand binding domain comprises an antigen binding domain that comprises an antibody fragment. In further aspects, the first extracellular ligand binding domain comprises an antibody fragment that comprises a scFv or an sdAb.

The term "antibody," as used herein, refers to a protein, or polypeptide sequences derived from an immunoglobulin molecule, which specifically binds to an antigen. Antibodies can be intact immunoglobulins of polyclonal or monoclonal origin, or fragments thereof and can be derived from natural or from recombinant sources.

The terms "antibody fragment" or "antibody binding domain" refer to at least one portion of an antibody, or recombinant variants thereof, that contains the antigen binding domain, i.e., an antigenic determining variable region of an intact antibody, that is sufficient to confer recognition and specific binding of the antibody fragment to a target, such as an antigen and its defined epitope. Examples of antibody fragments include, but are not limited to, Fab, Fab', F(ab')2, and Fv fragments, single-chain (sc)Fv ("scFv") antibody fragments, linear antibodies, single domain antibodies (abbreviated "sdAb") (either VL or VH), camelid VHH domains, and multi-specific antibodies formed from antibody fragments.

The term "scFv" refers to a fusion protein comprising at least one antibody fragment comprising a variable region of a light chain and at least one antibody fragment comprising a variable region of a heavy chain, wherein the light and heavy chain variable regions are contiguously linked via a short flexible polypeptide linker, and capable of being expressed as a single polypeptide chain, and wherein the scFv retains the specificity of the intact antibody from which it is derived.

"Heavy chain variable region" or "VH" (or, in the case of single domain antibodies, e.g., nanobodies, "VHH") with regard to an antibody refers to the fragment of the heavy chain that contains three CDRs interposed between flanking stretches known as framework regions, these framework regions are generally more highly conserved than the CDRs and form a scaffold to support the CDRs.

Unless specified, as used herein a scFv may have the VL and VH variable regions in either order, e.g., with respect to the N-terminal and C-terminal ends of the polypeptide, the scFv may comprise VL-linker-VH or may comprise VH-linker-VL.

In some embodiments, the antigen binding domain of the activator and/or inhibitory receptor comprises an scFv. In some embodiments, the scFv comprises a VL and VH region joined by a linker. In some embodiments, the linker comprises a glycine serine linker, for example GGGGSGGGGSGGGGSGG (SEQ ID NO: 152). In some embodiments, the scFv further comprises a signal sequence at the N terminus of the scFv. Exemplary signal sequences include MDMRVPAQLLGLLLLWLRGARC (SEQ ID NO: 362), which is encoded by ATGGACATGAGGGTCCCCGCTCAGCTCCTGGGGCTCCTGCTACTCTGGCTCCGAG GTGCCAGATGT (SEQ ID NO: 153).

The term "antibody light chain," refers to the smaller of the two types of polypeptide chains present in antibody molecules in their naturally occurring conformations. Kappa ("κ") and lambda ("λ") light chains refer to the two major antibody light chain isotypes.

The term "recombinant antibody" refers to an antibody that is generated using recombinant DNA technology, such as, for example, an antibody expressed by a bacteriophage or yeast expression system. The term should also be construed to mean an antibody which has been generated by the synthesis of a DNA molecule encoding the antibody and which DNA molecule expresses an antibody protein, or an amino acid sequence specifying the antibody, wherein the DNA or amino acid sequence has been obtained using recombinant DNA or amino acid sequence technology which is available and well known in the art.

The term "Vβ domain", "Vβ-only domain", "β chain variable domain" or "single variable domain TCR (svd-TCR)" refers to an antigen binding domain that consists essentially of a single T Cell Receptor (TCR) beta variable domain that specifically binds to an antigen in the absence of a second TCR variable domain. The Vβ-only domain engages antigen using complementarity-determining regions (CDRs). Each Vβ-only domain contains three complement determining regions (CDR1, CDR2, and CDR3). Additional elements may be combined provided that the VP domain is configured to bind the epitope in the absence of a second TCR variable domain.

In some embodiments, the extracellular ligand binding domain of the first receptor comprises an antibody fragment, a single chain Fv antibody fragment (scFv), or a β chain variable domain (Vβ).

In some embodiments, the extracellular ligand binding domain of the first receptor comprises a TCR α chain variable domain and a TCR β chain variable domain.

In some embodiments, the extracellular ligand binding domain of the first receptor comprises an scFv antigen binding domain. Exemplary MSLN scFv are shown in Table 1 below.

TABLE 1

Exemplary MSLN scFv domains

| | Protein Sequence | DNA Sequence |
|---|---|---|
| M5 | QVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSGGDIVMTQSSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIK (SEQ ID NO: 3) | CAGGTGCAGCTGGTGCAGTCTGGGGCTGAGGTGGAGAAGCCTGGGGCCTCAGTGAAGGTCTCCTGCAAGGCTTCTGGATACACCTTCACCGACTACTATATGCACTGGGTGCGACAGGCCCCTGGACAAGGGCTTGAGTGGATGGGATGGATCAACCCTAACAGTGGTGGCACAAACTATGCACAGAAGTTTCAGGGCAGGGTCACCATGACCAGGGACACGTCCATCAGCACAGCCTACATGGAGCTGAGCAGGCTGAGATCTGACGACACGGCCGTGTATTACTGTGCGTCTGGCTGGGACTTTGACTACTGGGGCCAGGGAACCCTGGTCACCGTGTCCTCAGGCGGAGGTGGAAGCGGAGGGGAGGATCTGGCGGCGGAGGAAGCGGAGGCGACATCGTGATGACCCAGTCTTCCTCCCTGTCTGCATCTGTCGGAGACAGAGTCACCATCACTTGCCGGGCCAGTCAGAGCATTAGGTACTATTTAAGTTGGTATCAGCAGAAACCAGGAAAAGCCCCTAAGCTCCTGATCTATACTGCATCCATTTTACAAAATGGGGTCCCATCAAGGTTCAGTGGCAGTGGATCTGGGACAGATTTCACTCTCACCATCAGCAGCCTGCAACCTGAGGATTTTGCAACTTATTACTGCCTCCAGACTTACACTCCTGACTTTGGCCCAGGGACCAAGGTGGAAATCAAA (SEQ ID NO: 363) |
| M14 | QVQLVQSGAEVRAPGASVKISCKASGFTFRGYYIHWVRQAPGQGLEWMGIINPSGGSRAYAQKFQGRVTMTRDTSTSTVYMELSSLRSDDTAMYYCARTASCGGDCYYLDYWGQGTLVTVSSGGGGSGGGGSGGGGSGGDIQMTQSPPTLSASVGDRVTITCRASENVNIWLAWYQQKPGKAPKLLIYKSSSLASGVPSRFSGSGSGAEFTLTISSLQPDDFATYYCQQYQSYPLTFGGGTKVEIK (SEQ ID NO: 4) | CAGGTGCAGCTGGTGCAGTCTGGGGCTGAGGTGAGGGCACCTGGGGCCTCAGTGAAGATTTCCTGCAAGGCTTCTGGATTCACCTTCAGAGGCTACTATATCCACTGGGTGCGACAGGCCCCTGGACAAGGGCTTGAGTGGATGGGAATCATCAACCCTAGTGGTGGTAGCAGAGCCTACGCACAGAAGTTCCAGGGCAGGGTCACCATGACCAGGGACACTTCCACGAGCACAGTCTACATGGAGCTGAGCAGCCTGAGATCTGACGACACGGCCATGTATTACTGTGCGAGAACCGCAAGTTGTGGTGGTGACTGCTACTACCTTGACTACTGGGGCCAGGGAACCCTGGTCACCGTGTCCTCAGGCGGAGGTGGAAGCGGAGGGGGAGGATCTGGCGGCGGAGGAAGCGGAGGCGACATCCAGATGACCCAGTCTCCTCCCACCCTGTCTGCATCTGTAGGAGACAGAGTCACCATCACTTGCCGGGCCAGTGAGAATGTTAATATCTGGTTGGCCTGGTATCAGCAGAAACCAGGGAAAGCCCCTAAGCTCCTGATCTATAAGTCATCCAGTTTAGCAAGTGGGGTCCCATCAAGGTTCAGTGGCAGTGGATCTGGGGCAGAATTCACTCTCACCATCAGCAGCCTGCAGCCTGATGATTTTGCAACTTATTACTGCCAACAGTATCAAAGTTACCCCCTCACTTTCGGCGGAGGGACCAAGGTGGAAATCAAA (SEQ ID NO: 364) |
| S5H | QVQLVQSGAEVKKPGASVKVSCKASGYSFTGYTMNWVRQAPGQRLEWMGLITPYNGASSYNQKFRGRVTITRDTSASTAYMELSSLRSEDTAVYYCARGGYDRGFDYWGQGTTVTVSSGGGGSGGGSGGGGSGGDIQMTQSPSSLSASVGDRVTITCSASSSVSYMHWYQQKPGKAPKRLIYDTSKLASGVPSRFSGSGSGTEFTLTISSLQPEDFATYYCQQWSGYPLTFGQGTKLEIK (SEQ ID NO: 5) | CAGGTGCAGCTGGTGCAGTCTGGGGCTGAGGTGAAGAAGCCTGGGGCCTCAGTGAAGGTTTCCTGCAAGGCTTCTGGATACTCATTCACCGGCTACACCATGAACTGGGTGAGGCAGGCCCCTGGACAAAGACTTGAGTGGATGGGATTGATTACCCCTTACAATGGTGCTTCTAGCTACAACCAGAAGTTCAGGGGCAGGGTCACAATCACTAGAGACACGTCAGCCAGCACAGCCTACATGGAGCTCTCCAGCCTGAGATCTGAAGACACTGCAGTCTATTACTGTGCAAGGGGGGGTTACGACGGGAGGGGTTTTGACTACTGGGGCCAGGGAACCACGGTCACCGTGTCCTCAGGCGGAGGTGGAAGCGGAGGGGGAGGATCTGGCGGCGGAGGAAGCGGAGGCGACATCCAGATGACCCAGTCTCCTTCAAGCTTGTCTGCATCTGTAGGAGACAGGGTCACCATCACTTGCAGTGCCAGCTCAAGTGTAAGTTACATGCACTGGTATCAGCAGAAACCAGGCAAGGCCCCTAAGAGATTGATCTATGACACATCCAAATTAGCAAGTGGGGTCCCAAGTCGCTTCAGTGGCAGTGGATCTGGGACCGAATTCACTCTCACCATCAGCAGCTTGCAGCCTGAGGATTTTGCAACTTATTACTGCCAGCAGTGGAGTGGTTACCCTCTCACGTTCGGTCAGGGGACAAAGTTGGAAATCAAA (SEQ ID NO: 365) |

TABLE 1-continued

Exemplary MSLN scFv domains

| Protein Sequence | DNA Sequence |
|---|---|
| S5M QVQLQQSGPELEKP GASVKISCKASGYS FTGYTMNWVKQSHG KSLEWIGLITPYNG ASSYNQKFRGKATL TVDKSSSTAYMDLL SLTSEDSAVYFCAR GGYDGRGFDYWGQG TTVTVSSGGGGSGG GGSGGGGSGGDIEL TQSPAIMSASPGEK VTMTCSASSSVSYM HWYQQKSGTSPKRW IYDTSKLASGVPGR FSGSGSGNSYSLTI SSVEAEDDATYYCQ QWSGYPLTFGAGTK LEIK (SEQ ID NO: 6) | CAGGTGCAGCTGCAGCAGTCTGGGCCTGAGCTGGAGAAGCCT GGGGCCTCAGTGAAGATTTCCTGCAAGGCTTCTGGATACTCA TTCACCGGCTACACCATGAACTGGGTGAAGCAGAGCCATGGA AAAAGCCTTGAGTGGATTGGACTTATCACCCCTTACAATGGT GCTTCTAGCTACAACCAGAAGTTCAGGGGCAAGGCCACATTA ACTGTAGACAAGTCATCCAGCACAGCCTACATGGACCTCCTC AGCCTGACATCTGAAGACTCTGCAGTCTATTTCTGTGCAAGG GGGGGTTACGACGGGAGGGGTTTTGACTACTGGGGCCAGGGA ACCACGGTCACCGTGTCCTCAGGCGGAGGTGGAAGCGGAGGG GGAGGATCTGGCGGCGGAGGAAGCGGAGGCGACATCGAGCTC ACCCAGTCTCCTGCAATCATGTCTGCATCTCCAGGAGAGAAG GTCACCATGACTTGCAGTGCCAGCTCAAGTGTAAGTTACATG CACTGGTATCAGCAGAAATCAGGCACCTCTCCCTAAGAGATGG ATCTATGACACATCCAAATTGGCAAGTGGGGTCCCAGGTCGC TTCAGTGGCAGTGGATCTGGGAACTCTTACTCTCTCACCATC AGCAGCGTGGAGGCTGAGGATGCAACTTATTACTGCCAG CAGTGGAGTGGTTACCCTCTCACGTTCGGTGCTGGGACAAAG TTGGAAATCAAA (SEQ ID NO: 366) |
| SS1 QVQLQQSGPELEKP GASVKISCKASGYS FTGYTMNWVKQSHG KSLEWIGLITPYNG ASSYNQKFRGKATL TVDKSSSTAYMDLL SLTSEDSAVYFCAR GGYDGRGFDYWGQG TTVTVSSGGGGSGG GGSGGGGSDIELTQ SPAIMSASPGEKVT MTCSASSSVSYMHW YQQKSGTSPKRWIY DTSKLASGVPGRFS GSGSGNSYSLTISS VEAEDDATYYCQQW SGYPLTFGAGTKLE I (SEQ ID NO: 80 | ND |
| 1 EVQLVESGGGLVKP GGSLRLSCAASGFT FSNAWMSWVRQAPG KGLEWVGRIKSKTD GGTTDYAAPVKGRF TISRDDSKNTLYLQ MNSLKTEDTAVYYC TTDLPKLRNFHIWG QGTLVTVSSGGGGS GGGGSGGGGSGGDI QMTQSPSSLSASVG DRVTITCRASQSIS SYLNWYQQKPGKAP KLLIYAASSLQSGV PSRFSGSGSGTDFT LTISSLQPEDFATY YCQQSYSTPLTFGG GTKVEIK (SEQ ID NO: 154) | GAAGTGCAGCTGGTGGAAAGCGGCGGAGGCCTGGTGAAACCT GGCGGCAGCCTGAGACTGAGCTGCGCCGCCAGCGGCTTCACC TTCTCGAACGCCTGGATGAGCTGGGTCCGCCAGGCCCCTGGC AAGGGACTGGAATGGGTCGGACGGATCAAGAGCAAGACCGAC GGCGGCACCACCGACTACGCTGCCCCCGTGAAGGGCCGGTTC ACCATCAGCCGGGACGACAGCAAGAACACCCTGTACCTGCAG ATGAACAGCCTGAAAACCGAGGACACCGCCGTGTATTACTGT ACCACAGATCTTCCTAAGCTTAGGAATTTTCATATTTGGGGC CAGGGAACCCTGGTCACCGTGTCCTCAGGCGGAGGTGGAAGC GGAGGGGGAGGATCTGGCGGCGGAGGAAGCGGAGGCGACATC CAGATGACCCAGTCTCCATCCTCCCTGTCTGCATCTGTAGGA GACAGAGTCACCATCACTTGCCGGGCAAGTCAGAGCATTAGC AGCTATTTAAATTGGTATCAGCAGAAACCAGGGAAAGCCCCT AAGCTCCTGATCTATGCTGCATCCAGTTTGCAAAGTGGGGTC CCATCAAGGTTCAGTGGCAGTGGATCTGGGACAGATTTCACT CTCACCATCAGCAGTCTGCAACCTGAAGATTTTGCAACTTAC TACTGTCAACAGAGTTACAGTACCCCTCTCACTTTCGGCGGC GGAACAAAGGTGGAGATCAAG (SEQ ID NO: 367) |
| 2 EVQLVESGGGLVQP GGSLRLSCAASGFT FSSYAMHWVRQAPG KGLEYVSAISSNGG STYYANSVKGRFTI SRDNSKNTLYLQMG SLRAEDMAVYYCAS LEYHGFRQYGLRYW HWGQGTLVTVSSGG GGSGGGGSGGGGSG GDIQMTQSPSSLSA SVGDRVTITCRASQ SISSYLNWYQQKPG KAPKLLIYAASSLQ SGVPSRFSGSGSGT | GAAGTGCAGCTGGTGGAAAGCGGCGGAGGCCTGGTGCAGCCT GGCGGCAGCCTGAGACTGTCTTGCGCCGCCAGCGGCTTCACC TTCAGCAGCTACGCCATGCACTGGGTCCGCCAGGCCCCTGGC AAGGGACTGGAATACGTGTCCGCCATCAGCTCGAACGGCGGC AGCACCTACTACGCCAACAGCGTGAAGGGCCGGTTCACCATC AGCCGGGACAACAGCAAGAACACCCTGTACCTGCAGATGGGC AGCCTGCGGGCCGAGGATATGGCCGTGTATTACTGTGCGAGC CTAGAATACCATGGCTTTCGACAATATGGGCTTCGTTATTGG CATTGGGGCCAGGGAACCCTGGTCACCGTGTCCTCAGGCGGA GGTGGAAGCGGAGGGGGAGGATCTGGCGGCGGAGGAAGCGGA GGCGACATCCAGATGACCCAGTCTCCATCCTCCCTGTCTGCA TCTGTAGGAGACAGAGTCACCATCACTTGCCGGGCAAGTCAG AGCATTAGCAGCTATTTAAATTGGTATCAGCAGAAACCAGGG AAAGCCCCTAAGCTCCTGATCTATGCTGCATCCAGTTTGCAA AGTGGGGTCCCATCAAGGTTCAGTGGCAGTGGATCTGGGACA |

TABLE 1-continued

Exemplary MSLN scFv domains

| | Protein Sequence | DNA Sequence |
|---|---|---|
| | DFTLTISSLQPEDF ATYYCQQSYSTPLT FGGGTKVEIK (SEQ ID NO: 155) | GATTTCACTCTCACCATCAGCAGTCTGCAACCTGAAGATTTT GCAACTTACTACTGTCAACAGAGTTACAGTACCCCTCTCACT TTCGGCGGCGGAACAAAGGTGGAGATCAAG (SEQ ID NO: 368) |
| 3 | QLQLQESGSGLVKP SQTLSLTCAVSGGS ISSGGYSWSWIRQP PGKGLEWIGYIYHS GSTYYNPSLKSRVT ISVDRSKNQFSLKL SSVTAADTAVYYCA SIKFWFAGINYFFP WGQGTLVTVSSGGG GSGGGGSGGGGSGG DIQMTQSPSSLSAS VGDRVTITCRASQS ISSYLNWYQQKPGK APKLLIYAASSLQS GVPSRFSGSGSGTD FTLTISSLQPEDFA TYYCQQSYSTPLTF GGGTKVEIK (SEQ ID NO: 156) | CAGCTGCAGCTCCAGGAAAGCGGCAGCGGCCTGGTGAAACCC AGCCAGACCCTGAGCCTGACCTGTGCCGTGTCCGGCGGCAGC ATCAGCAGCGGCGGCTACAGCTGGTCCTGGATCAGACAGCCC CCTGGCAAGGGCCTGGAATGGATCGGCTACATCTACCACAGC GGCTCGACCTACTACAACCCCAGCCTGAAGTCCAGAGTGACC ATCAGCGTGGACAGAAGCAAGAACCAGTTCAGCCTGAAGCTG AGCAGCGTGACAGCCGCCGACACCGCTGTGTATTACTGTGCC AGCATAAAATTCTGGTTTGCGGGGATTAATTATTTTTTTCCG TGGGGCCAGGGAACCCTGGTCACCGTGTCCTCAGGCGGAGGT GGAAGCGGAGGGGGAGGATCTGGCGGCGGAGGAAGCGGAGGC GACATCCAGATGACCCAGTCTCCATCCTCCCTGTCTGCATCT GTAGGAGACAGAGTCACCATCACTTGCCGGGCAAGTCAGAGC ATTAGCAGCTATTTAAATTGGTATCAGCAGAAACCAGGGAAA GCCCCTAAGCTCCTGATCTATGCTGCATCCAGTTTGCAAAGT GGGGTCCCATCAAGGTTCAGTGGCAGTGGATCTGGGACAGAT TTCACTCTCACCATCAGCAGTCTGCAACCTGAAGATTTTGCA ACTTACTACTGTCAACAGAGTTACAGTACCCCTCTCACTTTC GGCGGCGGAACAAAGGTGGAGATCAAG (SEQ ID NO: 369) |
| 4 | EVQLVESGGGLVQP GGSLRLSCAASGFT FSSYWMHWVRQAPG KGLVWVSRINSDGS STSYADSVKGRFTI SRDNAKNTLYLQMN SLRAEDTAVYYCAS GFLGMGSNFIWGQG TLVTVSSGGGGSGG GGSGGGGSGGDIQM TQSPSSLSASVGDR VTITCRASQSISSY LNWYQQKPGKAPKL LIYAASSLQSGVPS RFSGSGSGTDFTLT ISSLQPEDFATYYC QQSYSTPLTFGGGT KVEIK (SEQ ID NO: 157) | GAAGTGCAGCTGGTGGAAAGCGGCGGAGGCCTGGTGCAGCCT GGCGGCAGCCTGAGACTGTCTTGCGCCGCCAGCGGCTTCACC TTCAGCAGCTACTGGATGCACTGGGTCCGCCAGGCCCCTGGC AAGGGACTGGTCTGGGTGTCTCGAATCAACAGCGACGGCAGC AGCACCAGCTACGCCGACAGCGTGAAGGGCCGGTTCACCATC AGCCGGGACAACGCCAAGAACACCCTGTACCTGCAGATGAAC AGCCTGCGGGCCGAGGACACCGCCGTGTATTACTGTGCAAGC GGATTTTTGGGAATGGGCTCGAATTTTATTTGGGGCCAGGGA ACCCTGGTCACCGTGTCCTCAGGCGGAGGTGGAAGCGGAGGG GGAGGATCTGGCGGCGGAGGAAGCGGAGGCGACATCCAGATG ACCCAGTCTCCATCCTCCCTGTCTGCATCTGTAGGAGACAGA GTCACCATCACTTGCCGGGCAAGTCAGAGCATTAGCAGCTAT TTAAATTGGTATCAGCAGAAACCAGGGAAAGCCCCTAAGCTC CTGATCTATGCTGCATCCAGTTTGCAAAGTGGGGTCCCATCA AGGTTCAGTGGCAGTGGATCTGGGACAGATTTCACTCTCACC ATCAGCAGTCTGCAACCTGAAGATTTTGCAACTTACTACTGT CAACAGAGTTACAGTACCCCTCTCACTTTCGGCGGCGGAACA AAGGTGGAGATCAAG (SEQ ID NO: 370) |
| 5 | QVQLQESGPGLVKP SQTLSLTCTVSGGS ISSGGYYWSWIRQH PGKGLEWIGYIYYS GSTYYNPSLKSLVT ISVDTSKNQFSLKL SSVTAADTAVYYCA SGDRARYFDLWGRG TLVTVSSGGGGSGG GGSGGGGSGGDIQM TQSPSSLSASVGDR VTITCRASQSISSY LNWYQQKPGKAPKL LIYAASSLQSGVPS RFSGSGSGTDFTLT ISSLQPEDFATYYC QQSYSTPLTFGGGT KVEIK (SEQ ID NO: 158) | CAGGTGCAGCTGCAGGAAAGCGGCCCTGGCCTGGTGAAACCC AGCCAGACCCTGAGCCTGACCTGCACAGTGTCCGGCGGCAGC ATCAGCAGCGGCGGCTACTACTGGTCCTGGATCAGACAGCAC CCCGGCAAGGGCCTGGAATGGATCGGCTACATCTACTACAGC GGCAGCACCTACTACAACCCCAGCCTGAAGTCCCTGGTGACA ATCTCCGTCGATACCAGCAAGAACCAGTTCAGCCTGAAGCTG AGCAGCGTGACAGCCGCCGACACCGCTGTGTATTACTGTGCA AGCGGGGACAGGGCACGGTACTTCGATCTCTGGGGCCGTGGC ACCCTGGTCACTGTGTCCTCAGGCGGAGGTGGAAGCGGAGGG GGAGGATCTGGCGGCGGAGGAAGCGGAGGCGACATCCAGATG ACCCAGTCTCCATCCTCCCTGTCTGCATCTGTAGGAGACAGA GTCACCATCACTTGCCGGGCAAGTCAGAGCATTAGCAGCTAT TTAAATTGGTATCAGCAGAAACCAGGGAAAGCCCCTAAGCTC CTGATCTATGCTGCATCCAGTTTGCAAAGTGGGGTCCCATCA AGGTTCAGTGGCAGTGGATCTGGGACAGATTTCACTCTCACC ATCAGCAGTCTGCAACCTGAAGATTTTGCAACTTACTACTGT CAACAGAGTTACAGTACCCCTCTCACTTTCGGCGGCGGAACA AAGGTGGAGATCAAG (SEQ ID NO: 371) |
| 6 | EVQLVESGGGLVQP GGSLRLSCAASGFT FSSYWMHWVRQAPG KGLVWVSRINSDGS STSYADSVKGRFTI SRDNAKNTLYLQMN SLRAEDTAVYYCAR YPRGYHQMVDAFDI WGQGTMVTVSSGGG | GAAGTGCAGCTGGTGGAAAGCGGCGGAGGCCTGGTGCAGCCT GGCGGCAGCCTGAGACTGTCTTGCGCCGCCAGCGGCTTCACC TTCAGCAGCTACTGGATGCACTGGGTCCGCCAGGCCCCTGGC AAGGGACTGGTCTGGGTGTCTCGAATCAACAGCGACGGCAGC AGCACCAGCTACGCCGACAGCGTGAAGGGCCGGTTCACCATC AGCCGGGACAACGCCAAGAACACCCTGTACCTGCAGATGAAC AGCCTGCGGGCCGAGGACACCGCCGTGTATTACTGTGCAAGA TATCCACGTGGATATCATCAGATGGTTGATGCTTTTGATATC TGGGGCCAAGGGACAATGGTCACCGTGTCCTCAGGCGGAGGT |

TABLE 1-continued

Exemplary MSLN scFv domains

| | Protein Sequence | DNA Sequence |
|---|---|---|
| | GSGGGGSGGGGSGG DIQMTQSPSSLSAS VGDRVTITCRASQS ISSYLNWYQQKPGK APKLLIYAASSLQS GVPSRFSGSGSGTD FTLTISSLQPEDFA TYYCQQSYSTPLTF GGGTKVEIK (SEQ ID NO: 159) | GGAAGCGGAGGGGGAGGATCTGGCGGCGGAGGAAGCGGAGGC GACATCCAGATGACCCAGTCTCCATCCTCCCTGTCTGCATCT GTAGGAGACAGAGTCACCATCACTTGCCGGGCAAGTCAGAGC ATTAGCAGCTATTTAAATTGGTATCAGCAGAAACCAGGGAAA GCCCCTAAGCTCCTGATCTATGCTGCATCCAGTTTGCAAAGT GGGGTCCCATCAAGGTTCAGTGGCAGTGGATCTGGGACAGAT TTCACTCTCACCATCAGCAGTCTGCAACCTGAAGATTTTGCA ACTTACTACTGTCAACAGAGTTACAGTACCCCTCTCACTTTC GGCGGCGGAACAAAGGTGGAGATCAAG (SEQ ID NO: 372) |
| 7 | QLQLQESGPGLVKP SETLSLTCTVSGGS ISSSSYYWGWIRQP PGKGLEWIGSIYYS GSTYYNPSLKSRVT ISVDTSKNQFSLKL SSVTAADTAVYYCA RVRFLAARTTIPEA NFLWGQGTLVTVSS GGGGSGGGGSGGGG SGGDIQMTQSPSSL SASVGDRVTITCRA SQSISSYLNWYQQK PGKAPKLLIYAASS LQSGVPSRFSGSGS GTDFTLTISSLQPE DFATYYCQQSYSTP LTFGGGTKVEIK (SEQ ID NO: 160) | CAGCTGCAGCTCCAGGAAAGCGGCCCTGGCCTGGTGAAACCC AGCGAGACACTGAGCCTGACCTGCACCGTGTCCGGCGGCAGC ATCAGCAGCAGCAGCTACTACTGGGGCTGGATCAGACAGCCC CCTGGCAAGGGCCTGGAATGGATCGGCTCGATCTACTACAGC GGCTCCACCTACTACAACCCCAGCCTGAAGGTCCAGAGTGACC ATCAGCGTGGACACCAGCAAGAACCAGTTCAGCCTGAAGCTG AGCAGCGTGACAGCCGCCGACACCGCTGTGTATTACTGTGCG AGAGTACGATTTTTGGCTGCTCGCACTACTATTCCGGAGGCG AATTTTCTTTGGGGCCAGGGAACCCTGGTCACCGTGTCCTCA GGCGGAGGTGGAAGCGGAGGGGGAGGATCTGGCGGCGGAGGA AGCGGAGGCGACATCCAGATGACCCAGTCTCCATCCTCCCTG TCTGCATCTGTAGGAGACAGAGTCACCATCACTTGCCGGGCA AGTCAGAGCATTAGCAGCTATTTAAATTGGTATCAGCAGAAA CCAGGGAAAGCCCCTAAGCTCCTGATCTATGCTGCATCCAGT TTGCAAAGTGGGGTCCCATCAAGGTTCAGTGGCAGTGGATCT GGGACAGATTTCACTCTCACCATCAGCAGTCTGCAACCTGAA GATTTTGCAACTTACTACTGTCAACAGAGTTACAGTACCCCT CTCACTTTCGGCGGCGGAACAAAGGTGGAGATCAAG (SEQ ID NO: 373) |
| 8 | EVQLVESGGGLVQP GGSLRLSCAASGFT FSSYSMNWVRQAPG KGLEWVSYISSSSS TIIYYADSVKGRFTI SRDNAKNSLYLQMN SLRAEDTAVYYCAR VLSRARFDYWGQGT LVTVSSGGGGSGGG GSGGGGSGGDIQMT QSPSSLSASVGDRV TITCRASQSISSYL NWYQQKPGKAPKLL IYAASSLQSGVPSR FSGSGSGTDFTLTI SSLQPEDFATYYCQ QSYSTPLTFGGGTK VEIK (SEQ ID NO: 161) | GAAGTGCAGCTGGTGGAAAGCGGCGGAGGCCTGGTGCAGCCT GGCGGCAGCCTGAGACTGTCTTGCGCCGCCAGCGGCTTCACC TTCAGCAGCTACAGCATGAACTGGGTCCGCCAGGCCCCTGGC AAGGGACTGGAATGGGTGTCCTACATCAGCAGCAGCAGCTCC ACCATCTACTACGCCGACAGCGTGAAGGGCCGGTTCACCATC AGCCGGGACAACGCCAAGAACAGCCTGTACCTGCAGATGAAC AGCCTGCGGGCCGAGGACACCGCCGTGTATTACTGTGCGAGA GTACTCTCCAGGGCTAGGTTTGACTACTGGGGCCAGGGAACC CTGGTCACCGTGTCCTCAGGCGGAGGTGGAAGCGGAGGGGGA GGATCTGGCGGCGGAGGAAGCGGAGGCGACATCCAGATGACC CAGTCTCCATCCTCCCTGTCTGCATCTGTAGGAGACAGAGTC ACCATCACTTGCCGGGCAAGTCAGAGCATTAGCAGCTATTTA AATTGGTATCAGCAGAAACCAGGGAAAGCCCCTAAGCTCCTG ATCTATGCTGCATCCAGTTTGCAAAGTGGGGTCCCATCAAGG TTCAGTGGCAGTGGATCTGGGACAGATTTCACTCTCACCATC AGCAGTCTGCAACCTGAAGATTTTGCAACTTACTACTGTCAA CAGAGTTACAGTACCCCTCTCACTTTCGGCGGCGGAACAAAG GTGGAGATCAAG (SEQ ID NO: 374) |
| 9 | EVQLVESGGGLVKP GGSLRLSCAASGFT FSSYSMNWVRQAPG KGLEWVSSISSSSS YIYYADSVKGRFTI SRDNAKNSLYLQMN SLRAEDTAVYYCAR LRGRVFDPWGQGTL VTVSSGGGGSGGGG SGGGGSGGDIQMTQ SPSSLSASVGDRVT ITCRASQSISSYLN WYQQKPGKAPKLLI YAASSLQSGVPSRF SGSGSGTDFTLTIS SLQPEDFATYYCQQ SYSTPLTFGGGTKV EIK (SEQ ID NO: 162) | GAAGTGCAGCTGGTGGAAAGCGGCGGAGGCCTGGTGAAACCT GGCGGCAGCCTGAGACTGAGCTGCGCCGCCAGCGGCTTCACC TTCAGCAGCTACAGCATGAACTGGGTCCGCCAGGCCCCTGGC AAGGGACTGGAATGGGTGTCCTCGATCAGCAGCAGCAGCTCC TACATCTACTACGCCGACAGCGTGAAGGGCCGGTTCACCATC AGCCGGGACAACGCCAAGAACAGCCTGTACCTGCAGATGAAC AGCCTGCGGGCCGAGGACACCGCCGTGTATTACTGTGCGAGA TTACGAGGGAGGGTGTTCGACCCCTGGGGCCAGGGAACCCTG GTCACCGTGTCCTCAGGCGGAGGTGGAAGCGGAGGGGGAGGA TCTGGCGGCGGAGGAAGCGGAGGCGACATCCAGATGACCCAG TCTCCATCCTCCCTGTCTGCATCTGTAGGAGACAGAGTCACC ATCACTTGCCGGGCAAGTCAGAGCATTAGCAGCTATTTAAAT TGGTATCAGCAGAAACCAGGGAAAGCCCCTAAGCTCCTGATC TATGCTGCATCCAGTTTGCAAAGTGGGGTCCCATCAAGGTTC AGTGGCAGTGGATCTGGGACAGATTTCACTCTCACCATCAGC AGTCTGCAACCTGAAGATTTTGCAACTTACTACTGTCAACAG AGTTACAGTACCCCTCTCACTTTCGGCGGCGGAACAAAGGTG GAGATCAAG (SEQ ID NO: 375) |
| 10 | QLQLQESGPGLVKP SETLSLTCTVSGGS ISSSSYYWGWIRQP | CAGCTGCAGCTCCAGGAAAGCGGCCCTGGCCTGGTGAAACCC AGCGAGACACTGAGCCTGACCTGCACCGTGTCCGGCGGCAGC ATCAGCAGCAGCAGCTACTACTGGGGCTGGATCAGACAGCCC |

TABLE 1-continued

Exemplary MSLN scFv domains

| | Protein Sequence | DNA Sequence |
|---|---|---|
| | PGKGLEWIGSIYYS GSTYYNPSLKSRVT ISVDTSKNQFSLKL SSVTAADTAVYYCA RIKFTSFLYVHGFL WGQGTLVTVSSGGG GSGGGGSGGGGSGG DIQMTQSPSSLSAS VGDRVTITCRASQS ISSYLNWYQQKPGK APKLLIYAASSLQS GVPSRFSGSGSGTD FTLTISSLQPEDFA TYYCQQSYSTPLTF GGGTKVEIK (SEQ ID NO: 163) | CCTGGCAAGGGCCTGGAATGGATCGGCTCGATCTACTACAGC GGCTCCACCTACTACAACCCCAGCCTGAAGTCCAGAGTGACC ATCAGCGTGGACACCAGCAAGAACCAGTTCAGCCTGAAGCTG AGCAGCGTGACAGCCGCCGACACCGCTGTGTATTACTGTGCG AGAATAAAATTTACCAGCTTTTTATATGTTCATGGTTTTCTG TGGGGCCAGGGAACCCTGGTCACCGTGTCCTCAGGCGGAGGT GGAAGCGGAGGGGGAGGATCTGGCGGCGGAGGAAGCGGAGGC GACATCCAGATGACCCAGTCTCCATCCTCCCTGTCTGCATCT GTAGGAGACAGAGTCACCATCACTTGCCGGGCAAGTCAGAGC ATTAGCAGCTATTTAAATTGGTATCAGCAGAAACCAGGGAAA GCCCCTAAGCTCCTGATCTATGCTGCATCCAGTTTGCAAAGT GGGGTCCCATCAAGGTTCAGTGGCAGTGGATCTGGGACAGAT TTCACTCTCACCATCAGCAGTCTGCAACCTGAAGATTTTGCA ACTTACTACTGTCAACAGAGTTACAGTACCCCTCTCACTTTC GGCGGCGGAACAAAGGTGGAGATCAAG (SEQ ID NO: 376) |
| 11 | QVQLVQSGAEVKKP GASVKVSCKASGYT FTSYAMHWVRQAPG QRLEWMGWINAGNG NTKYSQKFQGRVTI TRDTSASTAYMELS SLRSEDTAVYYCAR GQRWLYLGGIRRHW GQGTLVTVSSGGGG SGGGGSGGGGSGGD IQMTQSPSSLSASV GDRVTITCRASQSI SSYLNWYQQKPGKA PKLLIYAASSLQSG VPSRFSGSGSGTDF TLTISSLQPEDFAT YYCQQSYSTPLTFG GGTKVEIK (SEQ ID NO: 164) | CAGGTGCAGCTGGTGCAGTCTGGCGCCGAAGTGAAGAAACCT GGCGCCTCCGTGAAGGTGTCCTGCAAGGCCAGCGGCTACACC TTCACCAGCTACGCCATGCACTGGGTTCGACAGGCCCCTGGC CAGAGACTGGAATGGATGGGCTGGATCAACGCCGGCAACGGC AACACCAAGTACAGCCAGAAATTCCAGGGCAGAGTGACCATC ACCCGGGACACCAGCGCCAGCACCGCCTACATGGAACTGAGC AGCCTGAGGAGCGAGGACACCGCTGTGTATTACTGTGCGAGA GGCCAGAGATGGCTGTACCTCGGGGGATTCGTCGGCATTGG GGCCAGGGAACCCTGGTCACCGTGTCCTCAGGCGGAGGTGGA AGCGGAGGGGGAGGATCTGGCGGCGGAGGAAGCGGAGGCGAC ATCCAGATGACCCAGTCTCCATCCTCCCTGTCTGCATCTGTA GGAGACAGAGTCACCATCACTTGCCGGGCAAGTCAGAGCATT AGCAGCTATTTAAATTGGTATCAGCAGAAACCAGGGAAAGCC CCTAAGCTCCTGATCTATGCTGCATCCAGTTTGCAAAGTGGG GTCCCATCAAGGTTCAGTGGCAGTGGATCTGGGACAGATTTC ACTCTCACCATCAGCAGTCTGCAACCTGAAGATTTTGCAACT TACTACTGTCAACAGAGTTACAGTACCCCTCTCACTTTCGGC GGCGGAACAAAGGTGGAGATCAAG (SEQ ID NO: 377) |
| 12 | QVQLQESGPGLVKP SETLSLTCTVSGGS ISSYYWSWIRQPPG KGLEWIGYIYYSGS TNYNPSLKSRVTIS VDTSKNQFSLKLSS VTAADTAVYYCARE WIPSRPYYFDYWGQ GTLVTVSSGGGGSG GGSGGGGSGGDIQ MTQSPSSLSASVGD RVTITCRASQSISS YLNWYQQKPGKAPK LLIYAASSLQSGVP SRFSGSGSGTDFTL TISSLQPEDFATYY CQQSYSTPLTFGGG TKVEIK (SEQ ID NO:165) | CAGGTGCAGCTGCAGGAAAGCGGCCCTGGCCTGGTGAAACCC AGCGAGACACTGAGCCTGACCTGCACAGTGTCCGGCGGCTCG ATCAGCAGCTACTACTGGTCCTGGATCAGACAGCCCCCTGGC AAGGGCCTGGAATGGATCGGCTACATCTACTACAGCGGCAGC ACCAACTACAACCCCAGCCTGAAGTCCAGAGTGACCATCTCC GTCGATACCAGCAAGAACCAGTTCAGCCTGAAGCTGAGCAGC GTGACAGCCGCCGACACCGCTGTGTATTACTGTGCGAGAGAA TGGATTCCCAGCCGTCCGTACTACTTTGACTACTGGGGCCAA GGAACCCTGGTCACCGTGTCCTCAGGCGGAGGTGGAAGCGGA GGGGGAGGATCTGGCGGCGGAGGAAGCGGAGGCGACATCCAG ATGACCCAGTCTCCATCCTCCCTGTCTGCATCTGTAGGAGAC AGAGTCACCATCACTTGCCGGGCAAGTCAGAGCATTAGCAGC TATTTAAATTGGTATCAGCAGAAACCAGGGAAAGCCCCTAAG CTCCTGATCTATGCTGCATCCAGTTTGCAAAGTGGGGTCCCA TCAAGGTTCAGTGGCAGTGGATCTGGGACAGATTTCACTCTC ACCATCAGCAGTCTGCAACCTGAAGATTTTGCAACTTACTAC TGTCAACAGAGTTACAGTACCCCTCTCACTTTCGGCGGCGGA ACAAAGGTGGAGATCAAG (SEQ ID NO: 378) |
| 13 | QVQLQESGPGLVKP SQTLSLTCTVSGGS ISSGGYYWSWIRQP PGKGLEWIGYIYYS GSTYYNPSLKSRVT ISVDTSKNQFSLKL SSVTAADTAVYYCA RESTGTGAFDIWGQ GTMVTVSSGGGGSG GGSGGGGSGGDIQ MTQSPSSLSASVGD RVTITCRASQSISS YLNWYQQKPGKAPK LLIYAASSLQSGVP | CAGGTGCAGCTGCAGGAAAGCGGCCCTGGCCTGGTGAAACCC AGCCAGACCCTGAGCCTGACCTGCACAGTGTCCGGCGGCTCG ATCAGCAGCGGCGGCTACTACTGGTCCTGGATCAGACAGCCC CCTGGCAAGGGCCTGGAATGGATCGGCTACATCTACTACAGC GGCAGCACCTACTACAACCCCAGCCTGAAGTCCAGAGTGACC ATCAGCGTGGACACCAGCAAGAACCAGTTCAGCCTGAAGCTG AGCAGCGTGACAGCCGCCGACACCGCTGTGTATTACTGTGCG AGAGAAAGTACCGGTACAGGAGCTTTTGATATCTGGGGCCAA GGGACAATGGTCACCGTGTCCTCAGGCGGAGGTGGAAGCGGA GGGGGAGGATCTGGCGGCGGAGGAAGCGGAGGCGACATCCAG ATGACCCAGTCTCCATCCTCCCTGTCTGCATCTGTAGGAGAC AGAGTCACCATCACTTGCCGGGCAAGTCAGAGCATTAGCAGC TATTTAAATTGGTATCAGCAGAAACCAGGGAAAGCCCCTAAG CTCCTGATCTATGCTGCATCCAGTTTGCAAAGTGGGGTCCCA |

TABLE 1-continued

Exemplary MSLN scFv domains

| | Protein Sequence | DNA Sequence |
|---|---|---|
| | SRFSGSGSGTDFTL TISSLQPEDFATYY CQQSYSTPLTFGGG TKVEIK (SEQ ID NO: 166) | TCAAGGTTCAGTGGCAGTGGATCTGGGACAGATTTCACTCTC ACCATCAGCAGTCTGCAACCTGAAGATTTTGCAACTTACTAC TGTCAACAGAGTTACAGTACCCCTCTCACTTTCGGCGGCGGA ACAAAGGTGGAGATCAAG (SEQ ID NO: 379) |
| 14 | EVQLVESGGGVVRP GGSLRLSCAASGFT FDDYGMSWVRQAPG KGLEWVSGINWNGG STGYADSVKGRFTI SRDNAKNSLYLQMN SLRAEDTALYHCAR ERYRRVLHWYFDLW GRGTLVTVSSGGGG SGGGGSGGGGSGGD IQMTQSPSSLSASV GDRVTITCRASQSI SSYLNWYQQKPGKA PKLLIYAASSLQSG VPSRFSGSGSGTDF TLTISSLQPEDFAT YYCQQSYSTPLTFG GGTKVEIK (SEQ ID NO: 167) | GAAGTGCAGCTGGTGGAAAGCGGAGGCGGAGTGGTTCGACCT GGCGGAAGCCTGAGACTGTCTTGCGCCGCCAGCGGCTTCACC TTTGACGACTACGGCATGAGCTGGGTCCGCCAGGCCCCTGGC AAGGGACTGGAATGGGTGTCCGGCATCAACTGGAACGGCGGC AGCACCGGCTACGCCGACAGCGTGAAGGGCCGGTTCACCATC AGCCGGGACAACGCCAAGAACAGCCTGTACCTGCAGATGAAC AGCCTGCGGGCCGAGGACACCGCCTTGTATCACTGTGCGAGA GAGAGGTACAGGCGGGTACTCCACTGGTACTTCGATCTCTGG GGCCGTGGCACCCTGGTCACTGTGTCCTCAGGCGGAGGTGGA AGCGGAGGGGGAGGATCTGGCGGCGGAGGAAGCGGAGGCGAC ATCCAGATGACCCAGTCTCCATCCTCCCTGTCTGCATCTGTA GGAGACAGAGTCACCATCACTTGCCGGGCAAGTCAGAGCATT AGCAGCTATTTAAATTGGTATCAGCAGAAACCAGGGAAAGCC CCTAAGCTCCTGATCTATGCTGCATCCAGTTTGCAAAGTGGG GTCCCATCAAGGTTCAGTGGCAGTGGATCTGGGACAGATTTC ACTCTCACCATCAGCAGTCTGCAACCTGAAGATTTTGCAACT TACTACTGTCAACAGAGTTACAGTACCCCTCTCACTTTCGGC GGCGGAACAAAGGTGGAGATCAAG (SEQ ID NO: 380) |
| 15 | QVQLVQSGAEVKKP GASVKVSCKASGYT FTSYDINWVRQATG QGLEWMGWMNPNSG NTGYAQKFQGRVTM TRNTSISTAYMELS SLRSEDTAVYYCAR EPDAFDIWGQGTMV TVSSGGGGSGGGGS GGGGSGGDIQMTQS PSSLSASVGDRVTI TCRASQSISSYLNW YQQKPGKAPKLLIY AASSLQSGVPSRFS GSGSGTDFTLTISS LQPEDFATYYCQQS YSTPLTFGGGTKVE IK (SEQ ID NO: 168) | CAGGTGCAGCTGGTGCAGTCTGGCGCCGAAGTGAAGAAACCT GGCGCCTCCGTGAAGGTGTCCTGCAAGGCCAGCGGCTACACC TTCACCAGCTACGACATCAACTGGGTCCGCCAGGCCACCGGA CAGGGCCTGGAATGGATGGGCTGGATGAACCCCAACAGCGGC AACACCGGCTACGCCCAGAAATTCCAGGGCAGAGTGACCATG ACCCGGAACACCTCGATCAGCACCGCCTACATGGAACTGAGC AGCCTGCGGAGCGAGGACACCGCTGTGTATTACTGTGCGAGA GAACCGGATGCTTTTGATATCTGGGGCCAAGGGACAATGGTC ACCGTGTCCTCAGGCGGAGGTGGAAGCGGAGGGGGAGGATCT GGCGGCGGAGGAAGCGGAGGCGACATCCAGATGACCCAGTCT CCATCCTCCCTGTCTGCATCTGTAGGAGACAGAGTCACCATC ACTTGCCGGGCAAGTCAGAGCATTAGCAGCTATTTAAATTGG TATCAGCAGAAACCAGGGAAAGCCCCTAAGCTCCTGATCTAT GCTGCATCCAGTTTGCAAAGTGGGGTCCCATCAAGGTTCAGT GGCAGTGGATCTGGGACAGATTTCACTCTCACCATCAGCAGT CTGCAACCTGAAGATTTTGCAACTTACTACTGTCAACAGAGT TACAGTACCCCTCTCACTTTCGGCGGCGGAACAAAGGTGGAG ATCAAG (SEQ ID NO: 381) |
| 16 | QVQLQESGPGLVKP SQTLSLTCTVSGGS ISSGGYYWSWIRQP PGKGLEWIGYIYYS GSTYYNPSLKSRVT ISVDTSKNQFSLKL SSVTAADTAVYYCA REHMGTIPYYFDYW GQGTLVTVSSGGGG SGGGGSGGGGSGGD IQMTQSPSSLSASV GDRVTITCRASQSI SSYLNWYQQKPGKA PKLLIYAASSLQSG VPSRFSGSGSGTDF TLTISSLQPEDFAT YYCQQSYSTPLTFG GGTKVEIK (SEQ ID NO: 169) | CAGGTGCAGCTGCAGGAAAGCGGCCCTGGCCTGGTGAAACCC AGCCAGACCCTGAGCCTGACCTGCACAGTGTCCGGCGGCTCG ATCAGCAGCGGCGGCTACTACTGGTCCTGGATCAGACAGCCC CCTGGCAAGGGCCTGGAATGGATCGGCTACATCTACTACAGC GGCAGCACCTACTACAACCCCAGCCTGAAGTCCAGAGTGACC ATCAGCGTGGACACCAGCAAGAACCAGTTCAGCCTGAAGCTG AGCAGCGTGACAGCCGCCGACACCGCTGTGTATTACTGTGCA AGAGAACATATGGGGACGATTCCGTACTACTTTGACTACTGG GGCCAGGGAACCCTGGTCACCGTGTCCTCAGGCGGAGGTGGA AGCGGAGGGGGAGGATCTGGCGGCGGAGGAAGCGGAGGCGAC ATCCAGATGACCCAGTCTCCATCCTCCCTGTCTGCATCTGTA GGAGACAGAGTCACCATCACTTGCCGGGCAAGTCAGAGCATT AGCAGCTATTTAAATTGGTATCAGCAGAAACCAGGGAAAGCC CCTAAGCTCCTGATCTATGCTGCATCCAGTTTGCAAAGTGGG GTCCCATCAAGGTTCAGTGGCAGTGGATCTGGGACAGATTTC ACTCTCACCATCAGCAGTCTGCAACCTGAAGATTTTGCAACT TACTACTGTCAACAGAGTTACAGTACCCCTCTCACTTTCGGC GGCGGAACAAAGGTGGAGATCAAG (SEQ ID NO: 382) |
| 17 | QVQLQESGPGLVKP SQTLSLTCTVSGGS ISSGGYYWSWIRQP PGKGLEWIGYIYYS GSTYYNPSLKSRVT ISVDTSKNQFSLKL SSVTAADTAVYYCA REEFGYGDVLYWGQ GTLVTVSSGGGGSG | CAGGTGCAGCTGCAGGAAAGCGGCCCTGGCCTGGTGAAACCC AGCCAGACCCTGAGCCTGACCTGCACAGTGTCCGGCGGCTCG ATCAGCAGCGGCGGCTACTACTGGTCCTGGATCAGACAGCCC CCTGGCAAGGGCCTGGAATGGATCGGCTACATCTACTACAGC GGCAGCACCTACTACAACCCCAGCCTGAAGTCCAGAGTGACC ATCAGCGTGGACACCAGCAAGAACCAGTTCAGCCTGAAGCTG AGCAGCGTGACAGCCGCCGACACCGCTGTGTATTACTGTGCG AGAGAAGAGTTTGGTTATGGGGACGTCCTCTACTGGGGCCAG GGAACCCTGGTCACCGTGTCCTCAGGCGGAGGTGGAAGCGGA |

TABLE 1-continued

Exemplary MSLN scFv domains

| | Protein Sequence | DNA Sequence |
|---|---|---|
| | GGGSGGGGSGGDIQ MTQSPSSLSASVGD RVTITCRASQSISS YLNWYQQKPGKAPK LLIYAASSLQSGVP SRFSGSGSGTDFTL TISSLQPEDFATYY CQQSYSTPLTFGGG TKVEIK (SEQ ID NO: 170) | GGGGGAGGATCTGGCGGCGGAGGAAGCGGAGGCGACATCCAG ATGACCCAGTCTCCATCCTCCCTGTCTGCATCTGTAGGAGAC AGAGTCACCATCACTTGCCGGGCAAGTCAGAGCATTAGCAGC TATTTAAATTGGTATCAGCAGAAACCAGGGAAAGCCCCTAAG CTCCTGATCTATGCTGCATCCAGTTTGCAAAGTGGGGTCCCA TCAAGGTTCAGTGGCAGTGGATCTGGGACAGATTTCACTCTC ACCATCAGCAGTCTGCAACCTGAAGATTTTGCAACTTACTAC TGTCAACAGAGTTACAGTACCCCTCTCACTTTCGGCGGCGGA ACAAAGGTGGAGATCAAG (SEQ ID NO: 383) |
| 18 | QVQLQESGPGLVKP SQTLSLTCTVSGGS ISSGDYYWSWIRQP PGKGLEWIGYIYYS GSTYYNPSLKSRVT ISVDTSKNQFSLKL SSVTAADTAVYYCA REDVVKGAFDIWGQ GTMVTVSSGGGGSG GGGSGGGGSGGDIQ MTQSPSSLSASVGD RVTITCRASQSISS YLNWYQQKPGKAPK LLIYAASSLQSGVP SRFSGSGSGTDFTL TISSLQPEDFATYY CQQSYSTPLTFGGG TKVEIK (SEQ ID NO: 171) | CAGGTGCAGCTGCAGGAAAGCGGCCCTGGCCTGGTGAAACCC AGCCAGACCCTGAGCCTGACCTGCACAGTGTCCGGCGGCAGC ATCAGCAGCGGCGACTACTACTGGTCCTGGATCAGACAGCCC CCTGGCAAGGGCCTGGAATGGATCGGCTACATCTACTACAGC GGCAGCACCTACTACAACCCCAGCCTGAAGTCTCGAGTGACC ATCAGCGTGGACACCAGCAAGAACCAGTTCAGCCTGAAGCTG AGCAGCGTGACAGCCGCCGACACCGCTGTGTATTACTGTGCC AGAGAGGACGTAGTCAAAGGCGCTTTTGATATCTGGGGCCAA GGGACAATGGTCACCGTGTCCTCAGGCGGAGGTGGAAGCGGA GGGGGAGGATCTGGCGGCGGAGGAAGCGGAGGCGACATCCAG ATGACCCAGTCTCCATCCTCCCTGTCTGCATCTGTAGGAGAC AGAGTCACCATCACTTGCCGGGCAAGTCAGAGCATTAGCAGC TATTTAAATTGGTATCAGCAGAAACCAGGGAAAGCCCCTAAG CTCCTGATCTATGCTGCATCCAGTTTGCAAAGTGGGGTCCCA TCAAGGTTCAGTGGCAGTGGATCTGGGACAGATTTCACTCTC ACCATCAGCAGTCTGCAACCTGAAGATTTTGCAACTTACTAC TGTCAACAGAGTTACAGTACCCCTCTCACTTTCGGCGGCGGA ACAAAGGTGGAGATCAAG (SEQ ID NO: 384) |
| 19 | EVQLVESGGGLVQP GGSLRLSCAASGFT FSSYSMNWVRQAPG KGLEWVSYISSSSS TIYYADSVKGRFTI SRDNAKNSLYLQMN SLRAEDTAVYYCAR EDFSHKLGYFQHWG QGTLVTVSSGGGGS GGGGSGGGGSGGDI QMTQSPSSLSASVG DRVTITCRASQSIS SYLNWYQQKPGKAP KLLIYAASSLQSGV PSRFSGSGSGTDFT LTISSLQPEDFATY YCQQSYSTPLTFGG GTKVEIK (SEQ ID NO: 172) | GAAGTGCAGCTGGTGGAAAGCGGCGGAGGCCTGGTGCAGCCT GGCGGCAGCCTGAGACTGTCTTGCGCCGCCAGCGGCTTCACC TTCAGCAGCTACAGCATGAACTGGGTCCGCCAGGCCCCTGGC AAGGGACTGGAATGGGTGTCCTACATCAGCAGCAGCAGCTCC ACCATCTACTACGCCGACAGCGTGAAGGGTCGATTCACCATC AGCCGGGACAACGCCAAGAACAGCCTGTACCTGCAGATGAAC AGCCTGCGGGCCGAGGACACCGCCGTGTATTACTGTGCGAGA GAAGACTTCTCGCATAAGCTAGGGTACTTCCAGCACTGGGGC CAGGGCACCCTGGTCACCGTGTCCTCAGGCGGAGGTGGAAGC GGGGGAGGATCTGGCGGCGGAGGAAGCGGAGGCGACATC CAGATGACCCAGTCTCCATCCTCCCTGTCTGCATCTGTAGGA GACAGAGTCACCATCACTTGCCGGGCAAGTCAGAGCATTAGC AGCTATTTAAATTGGTATCAGCAGAAACCAGGGAAAGCCCCT AAGCTCCTGATCTATGCTGCATCCAGTTTGCAAAGTGGGGTC CCATCAAGGTTCAGTGGCAGTGGATCTGGGACAGATTTCACT CTCACCATCAGCAGTCTGCAACCTGAAGATTTTGCAACTTAC TACTGTCAACAGAGTTACAGTACCCCTCTCACTTTCGGCGGC GGAACAAAGGTGGAGATCAAG (SEQ ID NO: 385) |
| 20 | QVQLVESGGGLVKP GGSLRLSCAASGFT FSDYYMSWIRQAPG KGLEWVSYISSSGS TIYYADSVKGRFTI SRDNAKNSLYLQMN SLRAEDTAVYYCAR DYDYVWGQGTLVTV SSGGGGSGGGGSGG GGSGGDIQMTQSPS SLSASVGDRVTITC RASQSISSYLNWYQ QKPGKAPKLLIYAA SSLQSGVPSRFSGS GSGTDFTLTISSLQ PEDFATYYCQQSYS TPLTFGGGTKVEIK (SEQ ID NO: 173) | CAGGTGCAGCTGGTGGAAAGCGGCGGAGGCCTGGTGAAACCT GGCGGCAGCCTGAGACTGAGCTGCGCCGCCAGCGGCTTCACC TTCAGCGACTACTACATGAGCTGGATCAGACAGGCCCCTGGC AAGGGACTGGAATGGGTGTCCTACATCAGCAGCAGCGGCTCG ACCATCTACTACGCCGACAGCGTGAAGGGCCGGTTCACCATC AGCCGGGACAACGCCAAGAACAGCCTGTACCTGCAGATGAAC AGCCTGCGGGCCGAGGACACCGCCGTGTATTGTGCGAGA GATTACGATTACGTGTGGGGCCAGGGAACCCTGGTCACCGTG TCCTCAGGCGGAGGTGGAAGCGGAGGGGGAGGATCTGGCGGC GGAGGAAGCGGAGGCGACATCCAGATGACCCAGTCTCCATCC TCCCTGTCTGCATCTGTAGGAGACAGAGTCACCATCACTTGC CGGGCAAGTCAGAGCATTAGCAGCTATTTAAATTGGTATCAG CAGAAACCAGGGAAAGCCCCTAAGCTCCTGATCTATGCTGCA TCCAGTTTGCAAAGTGGGGTCCCATCAAGGTTCAGTGGCAGT GGATCTGGGACAGATTTCACTCTCACCATCAGCAGTCTGCAA CCTGAAGATTTTGCAACTTACTACTGTCAACAGAGTTACAGT ACCCCTCTCACTTTCGGCGGCGGAACAAAGGTGGAGATCAAG (SEQ ID NO: 386) |
| 21 | QVQLQESGPGLVKP SQTLSLTCTVSGGS ISSGDYYWSWIRQP PGKGLEWIGYIYYS | CAGGTGCAGCTGCAGGAAAGCGGCCCTGGCCTGGTGAAACCC AGCCAGACCCTGAGCCTGACCTGCACAGTGTCCGGCGGCAGC ATCAGCAGCGGCGACTACTACTGGTCCTGGATCAGACAGCCC CCTGGCAAGGGCCTGGAATGGATCGGCTACATCTACTACAGC |

TABLE 1-continued

Exemplary MSLN scFv domains

| | Protein Sequence | DNA Sequence |
|---|---|---|
| | GSTYYNPSLKSRVT ISVDTSKNQFSLKL SSVTAADTAVYYCA RDRRDWDWFDPWGQ GTLVTVSSGGGGSG GGGSGGGGSGGDIQ MTQSPSSLSASVGD RVTITCRASQSISS YLNWYQQKPGKAPK LLIYAASSLQSGVP SRFSGSGSGTDFTL TISSLQPEDFATYY CQQSYSTPLTFGGG TKVEIK (SEQ ID NO: 174) | GGCAGCACCTACTACAACCCCAGCCTGAAGTCTCGAGTGACC ATCAGCGTGGACACCAGCAAGAACCAGTTCAGCCTGAAGCTG AGCAGCGTGACAGCCGCCGACACCGCTGTGTATTACTGTGCC AGAGATCGCCGTGATTGGGACTGGTTCGACCCCTGGGGCCAG GGAACCCTGGTCACCGTGTCCTCAGGCGGAGGTGGAAGCGGA GGGGGAGGATCTGGCGGCGGAGGAAGCGGAGGCGACATCCAG ATGACCCAGTCTCCATCCTCCCTGTCTGCATCTGTAGGAGAC AGAGTCACCATCACTTGCCGGGCAAGTCAGAGCATTAGCAGC TATTTAAATTGGTATCAGCAGAAACCAGGGAAAGCCCCTAAG CTCCTGATCTATGCTGCATCCAGTTTGCAAAGTGGGGTCCCA TCAAGGTTCAGTGGCAGTGGATCTGGGACAGATTTCACTCTC ACCATCAGCAGTCTGCAACCTGAAGATTTTGCAACTTACTAC TGTCAACAGAGTTACAGTACCCCTCTCACTTTCGGCGGCGGA ACAAAGGTGGAGATCAAG (SEQ ID NO: 387) |
| 22 | QVQLQESGPGLVKP SGTLSLTCAVSGGS ISSSNWWSWVRQPP GKGLEWIGEIYHSG STNYNPSLKSRVTI SVDKSKNQFSLKLS SVTAADTAVYYCAR DQQALKYRVDWGQG TLVTVSSGGGGSGG GGSGGGGSGGDIQM TQSPSSLSASVGDR VTITCRASQSISSY LNWYQQKPGKAPKL LIYAASSLQSGVPS RFSGSGSGTDFTLT ISSLQPEDFATYYC QQSYSTPLTFGGGT KVEIK (SEQ ID NO: 175) | CAGGTGCAGCTGCAGGAAAGCGGCCCTGGCCTGGTGAAACCC AGCGGCACCCTGAGCCTGACCTGTGCCGTGTCTGGCGGCAGC ATCAGCAGCAGCAACTGGTGGTCCTGGGTCCGCCAGCCTCCC GGCAAGGGCCTCGAATGGATCGGCGAGATCTACCACAGCGGC AGCACCAACTACAACCCCAGCCTGAAGTCCAGAGTGACCATC AGCGTGGACAAGAGCAAGAACCAGTTCAGCCTGAAGCTGAGC AGCGTGACAGCCGCCGACACCGCTGTGTATTACTGTGCCAGA GATCAGCAGGCGTTGAAATACCGTGTGGATTGGGGCCAGGGA ACCCTGGTCACCGTGTCCTCAGGCGGAGGTGGAAGCGGAGGG GGAGGATCTGGCGGCGGAGGAAGCGGAGGCGACATCCAGATG ACCCAGTCTCCATCCTCCCTGTCTGCATCTGTAGGAGACAGA GTCACCATCACTTGCCGGGCAAGTCAGAGCATTAGCAGCTAT TTAAATTGGTATCAGCAGAAACCAGGGAAAGCCCCTAAGCTC CTGATCTATGCTGCATCCAGTTTGCAAAGTGGGGTCCCATCA AGGTTCAGTGGCAGTGGATCTGGGACAGATTTCACTCTCACC ATCAGCAGTCTGCAACCTGAAGATTTTGCAACTTACTACTGT CAACAGAGTTACAGTACCCCTCTCACTTTCGGCGGCGGAACA AAGGTGGAGATCAAG (SEQ ID NO: 388) |
| 23 | QVQLVQSGAEVKKP GASVKVSCKASGYT FTSYGISWVRQAPG QGLEWMGWISAYNG NTNYAQKLQGRVTM TTDTSTSTAYMELR SLRSDDTAVYYCAR DLTLGCFDYWGQGT LVTVSSGGGGSGGG GSGGGGSGGDIQMT QSPSSLSASVGDRV TITCRASQSISSYL NWYQQKPGKAPKLL IYAASSLQSGVPSR FSGSGSGTDFTLTI SSLQPEDFATYYCQ QSYSTPLTFGGGTK VEIK (SEQ ID NO: 176) | CAGGTGCAGCTGGTGCAGTCTGGCGCCGAAGTGAAGAAACCT GGCGCCTCCGTGAAGGTGTCCTGCAAGGCCAGCGGCTACACC TTCACCAGCTACGGCATCAGCTGGGTCCGCCAGGCTCCTGGA CAGGGACTGGAATGGATGGGCTGGATCAGCGCCTACAACGGC AACACCAACTACGCCCAGAAACTGCAGGGCAGGGTGACCATG ACCACCGACACCAGCACCAGCACCGCCTACATGGAACTTCGA AGCCTGAGAAGCGACGACACCGCCGTGTATTACTGTGCCAGA GATCTTACGCTAGGATGCTTTGACTACTGGGGCCAGGGAACC CTGGTCACCGTGTCCTCAGGCGGAGGTGGAAGCGGAGGGGGA GGATCTGGCGGCGGAGGAAGCGGAGGCGACATCCAGATGACC CAGTCTCCATCCTCCCTGTCTGCATCTGTAGGAGACAGAGTC ACCATCACTTGCCGGGCAAGTCAGAGCATTAGCAGCTATTTA AATTGGTATCAGCAGAAACCAGGGAAAGCCCCTAAGCTCCTG ATCTATGCTGCATCCAGTTTGCAAAGTGGGGTCCCATCAAGG TTCAGTGGCAGTGGATCTGGGACAGATTTCACTCTCACCATC AGCAGTCTGCAACCTGAAGATTTTGCAACTTACTACTGTCAA CAGAGTTACAGTACCCCTCTCACTTTCGGCGGCGGAACAAAG GTGGAGATCAAG (SEQ ID NO: 389) |
| 24 | EVQLVESGGGLVQP GGSLRLSCAASGFT VSSNYMSWVRQAPG KGLEWVSVIYSGGS TYYADSVKGRFTIS RDNSKNTLYLQMNS LRAEDTAVYYCARD GSNSWYFDLWGRGT LVTVSSGGGGSGGG GSGGGGSGGDIQMT QSPSSLSASVGDRV TITCRASQSISSYL NWYQQKPGKAPKLL IYAASSLQSGVPSR FSGSGSGTDFTLTI SSLQPEDFATYYCQ QSYSTPLTFGGGTK VEIK (SEQ ID NO: 177) | GAAGTGCAGCTGGTGGAAAGCGGCGGAGGCCTGGTGCAGCCT GGCGGCAGCCTGAGACTGTCTTGCGCCGCCAGCGGCTTCACC GTGTCCAGCAACTACATGAGCTGGGTCCGCCAGGCCCCTGGC AAGGGGACTGGAATGGGTGTCCGTGATCTACAGCGGCGGCAGC ACCTACTACGCCGACAGCGTGAAGGGTCGATTCACCATCAGC CGGGACAACAGCAAGAACACCCTGTACCTGCAGATGAACAGC CTGCGGGCCGAGGACACCGCCGTGTATTACTGTGCGAGAGAT GGGTCAAACTCTTGGTACTTCGATCTCTGGGGCCGTGGCACC CTGGTCACTGTGTCCTCAGGCGGAGGTGGAAGCGGAGGGGGA GGATCTGGCGGCGGAGGAAGCGGAGGCGACATCCAGATGACC CAGTCTCCATCCTCCCTGTCTGCATCTGTAGGAGACAGAGTC ACCATCACTTGCCGGGCAAGTCAGAGCATTAGCAGCTATTTA AATTGGTATCAGCAGAAACCAGGGAAAGCCCCTAAGCTCCTG ATCTATGCTGCATCCAGTTTGCAAAGTGGGGTCCCATCAAGG TTCAGTGGCAGTGGATCTGGGACAGATTTCACTCTCACCATC AGCAGTCTGCAACCTGAAGATTTTGCAACTTACTACTGTCAA CAGAGTTACAGTACCCCTCTCACTTTCGGCGGCGGAACAAAG GTGGAGATCAAG (SEQ ID NO: 390) |

TABLE 1-continued

Exemplary MSLN scFv domains

| | Protein Sequence | DNA Sequence |
|---|---|---|
| 25 | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARAFLFLSFSVWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK (SEQ ID NO: 178) | CAGGTGCAGCTGGTGGAAAGCGGCGGAGGCGTGGTGCAGCCCGGCAGAAGCCTTCGACTGAGCTGCGCCGCAAGCGGCTTCACCTTCAGCAGCTACGGCATGCACTGGGTCCGCCAGGCCCCTGGCAAGGGACTGGAATGGGTGGCCGTGATTTGGTACGACGGCAGCAACAAGTACTACGCCGACAGCGTGAAGGGCCGGTTCACCATCAGCCGGGACAACAGCAAGAACACCCTGTACCTGCAGATGAACAGCCTGCGGGCCGAGGACACCGCCGTGTATTACTGTGCGAGGGCATTTTTATTCCTGTCTTTTTCGGTTTGGGGCCAGGGAACCCTGGTCACCGTGTCCTCAGGCGGAGGTGGAAGCGGAGGGGGAGGATCTGGCGGCGGAGGAAGCGGAGGCGACATCCAGATGACCCAGTCTCCATCCTCCCTGTCTGCATCTGTAGGAGACAGAGTCACCATCACTTGCCGGGCAAGTCAGAGCATTAGCAGCTATTTAAATTGGTATCAGCAGAAACCAGGGAAAGCCCCTAAGCTCCTGATCTATGCTGCATCCAGTTTGCAAAGTGGGGTCCCATCAAGGTTCAGTGGCAGTGGATCTGGGACAGATTTCACTCTCACCATCAGCAGTCTGCAACCTGAAGATTTTGCAACTTACTACTGTCAACAGAGTTACAGTACCCCTCTCACTTTCGGCGGCGGAACAAAGGTGGAGATCAAG (SEQ ID NO: 391) |
| 26 | EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKGIFYSSKEDFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK (SEQ ID NO: 179) | GAAGTGCAGCTGGTGGAATCTGGCGGCGTGGTGGTGCAGCCTGGCGGCAGCCTGAGACTGTCTTGCGCCGCCAGCGGCTTCACCTTCGACGACTACACCATGCACTGGGTCCGCCAGGCCCCTGGCAAGGGACTGGAATGGGTGTCCCTGATCAGCTGGGACGGCGGCTCTACCTACTACGCCGACTCCGTGAAGGGCCGGTTCACCATCAGCCGGGACAACAGCAAGAACAGCCTGTACCTGCAGATGAACAGCCTGCGGACCGAGGACACCGCCTTGTATTACTGTGCAAAAGGGATATTCTACTCGAGTAAAGAGGATTTTGACTACTGGGGCCAGGGAACCCTGGTCACCGTGTCCTCAGGCGGAGGTGGAAGCGGAGGGGGAGGATCTGGCGGCGGAGGAAGCGGAGGCGACATCCAGATGACCCAGTCTCCATCCTCCCTGTCTGCATCTGTAGGAGACAGAGTCACCATCACTTGCCGGGCAAGTCAGAGCATTAGCAGCTATTTAAATTGGTATCAGCAGAAACCAGGGAAAGCCCCTAAGCTCCTGATCTATGCTGCATCCAGTTTGCAAAGTGGGGTCCCATCAAGGTTCAGTGGCAGTGGATCTGGGACAGATTTCACTCTCACCATCAGCAGTCTGCAACCTGAAGATTTTGCAACTTACTACTGTCAACAGAGTTACAGTACCCCTCTCACTTTCGGCGGCGGAACAAAGGTGGAGATCAAG (SEQ ID NO: 392) |
| 27 | EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKDIWIFYSSNPKPTVYWGQGTLVTVSSGGGGSGGGGSGGGGSGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK (SEQ ID NO: 180) | GAAGTGCAGCTGGTGGAATCTGGCGGCGTGGTGGTGCAGCCTGGCGGCAGCCTGAGACTGTCTTGCGCCGCCAGCGGCTTCACCTTCGACGACTACACCATGCACTGGGTCCGCCAGGCCCCTGGCAAGGGACTGGAATGGGTGTCCCTGATCAGCTGGGACGGCGGCTCTACCTACTACGCCGACTCCGTGAAGGGCCGGTTCACCATCAGCCGGGACAACAGCAAGAACAGCCTGTACCTGCAGATGAACAGCCTGCGGACCGAGGACACCGCCTTGTATTACTGTGCAAAAGATATATGGATATTCTACTCGAGTAATCCAAAGCCGACGGTCTACTGGGGCCAGGGAACCCTGGTCACCGTGTCCTCAGGCGGAGGTGGAAGCGGAGGGGGAGGATCTGGCGGCGGAGGAAGCGGAGGCGACATCCAGATGACCCAGTCTCCATCCTCCCTGTCTGCATCTGTAGGAGACAGAGTCACCATCACTTGCCGGGCAAGTCAGAGCATTAGCAGCTATTTAAATTGGTATCAGCAGAAACCAGGGAAAGCCCCTAAGCTCCTGATCTATGCTGCATCCAGTTTGCAAAGTGGGGTCCCATCAAGGTTCAGTGGCAGTGGATCTGGGACAGATTTCACTCTCACCATCAGCAGTCTGCAACCTGAAGATTTTGCAACTTACTACTGTCAACAGAGTTACAGTACCCCTCTCACTTTCGGCGGCGGAACAAAGGTGGAGATCAAG (SEQ ID NO: 393) |
| 28 | QVQLVQSGSELKKPGASVKVSCKASGYTFTSYAMNWVRQAPGQGLEWMGWINTNTGNPTYAQGFTGRFVFSFDTSVSTAYLQICSLKAEDTAVYYCARKDQTLTYGNWFDPWGQGTLVTVSSGGGGSGGGGSGGGGSGDIQMTQSPSSLSASVGDRVTITCRASQSISSYLNWYQQKPGKA | CAGGTGCAGCTGGTGCAGAGCGGCAGCGAGCTGAAGAAACCTGGCGCCTCCGTGAAGGTGTCCTGCAAGGCCAGCGGCTACACCTTCACCAGCTACGCCATGAACTGGGTCCGCCAGGCCCCAGGCCAGGGACTGGAATGGATGGGCTGGATCAACACCAACACCGGCAACCCCACCTACGCCCAGGGCTTCACCGGCAGATTCGTGTTCAGCTTCGACACCAGCGTGTCCACCGCCTACCTGCAGATCTGTAGCCTGAAGGCCGAGGACACCGCCGTGTATTACTGTGCGAGGAAGGATCAGACGCTGACCTACGGAAACTGGTTCGACCCCTGGGGCCAGGGAACCCTGGTCACCGTGTCCTCAGGCGGAGGTGGAAGCGGAGGGGGAGGATCTGGCGGCGGAGGAAGCGGAGGCGACATCCAGATGACCCAGTCTCCATCCTCCCTGTCTGCATCTGTAGGAGACAGAGTCACCATCACTTGCCGGGCAAGTCAGAGCATTAGCAGCTATTTAAATTGGTATCAGCAGAAACCAGGGAAAGCC |

TABLE 1-continued

Exemplary MSLN scFv domains

| | Protein Sequence | DNA Sequence |
|---|---|---|
| | PKLLIYAASSLQSG VPSRFSGSGSGTDF TLTISSLQPEDFAT YYCQQSYSTPLTFG GGTKVEIK (SEQ ID NO: 181) | CCTAAGCTCCTGATCTATGCTGCATCCAGTTTGCAAAGTGGG GTCCCATCAAGGTTCAGTGGCAGTGGATCTGGGACAGATTTC ACTCTCACCATCAGCAGTCTGCAACCTGAAGATTTTGCAACT TACTACTGTCAACAGAGTTACAGTACCCCTCTCACTTTCGGC GGCGGAACAAAGGTGGAGATCAAG (SEQ ID NO: 394) |
| 29 | QVQLQESGPGLVKP SETLSLTCTVSGGS VSSGSYYWSWIRQP PGKGLEWIGYIYYS GSTNYNPSLKSRVT ISVDTSKNQFSLKL SSVTAADTAVYYCA RDHYERGLYWGQGT LVTVSSGGGGSGGG GSGGGGSGGDIQMT QSPSSLSASVGDRV TITCRASQSISSYL NWYQQKPGKAPKLL IYAASSLQSGVPSR FSGSGSGTDFTLTI SSLQPEDFATYYCQ QSYSTPLTFGGGTK VEIK (SEQ ID NO: 182) | CAGGTGCAGCTGCAGGAAAGCGGCCCTGGCCTGGTGAAACCC AGCGAGACACTGAGCCTGACCTGCACCGTGTCCGGCGGCTCT GTGTCCAGCGGCTCCTACTACTGGTCCTGGATCAGACAGCCC CCTGGCAAGGGCCTCGAATGGATCGGCTACATCTACTACAGC GGCAGCACCAACTACAACCCCAGCCTGAAGTCCAGAGTGACC ATCAGCGTGGACACCAGCAAGAACCAGTTCAGCCTGAAGCTG AGCAGCGTGACAGCCGCCGACACCGCTGTGTATTACTGTGCG AGAGATCATTACGAGCGGGGCTCTACTGGGGCCAGGGAACC CTGGTCACCGTGTCCTCAGGCGGAGGTGGAAGCGGAGGGGGA GGATCTGGCGGCGGAGGAAGCGGAGGCGACATCCAGATGACC CAGTCTCCATCCTCCCTGTCTGCATCTGTAGGAGACAGAGTC ACCATCACTTGCCGGGCAAGTCAGAGCATTAGCAGCTATTTA AATTGGTATCAGCAGAAACCAGGGAAAGCCCCTAAGCTCCTG ATCTATGCTGCATCCAGTTTGCAAAGTGGGGTCCCATCAAGG TTCAGTGGCAGTGGATCTGGGACAGATTTCACTCTCACCATC AGCAGTCTGCAACCTGAAGATTTTGCAACTTACTACTGTCAA CAGAGTTACAGTACCCCTCTCACTTTCGGCGGCGGAACAAAG GTGGAGATCAAG (SEQ ID NO: 395) |
| 30 | QVQLVESGGGLVKP GGSLRLSCAASGFT FSDYYMSWIRQAPG KGLEWVSYISSSGS TIYYADSVKGRFTI SRDNAKNSLYLQMN SLRAEDTAVYYCAR YMYNWYFDLWGRGT LVTVSSGGGGSGGG GSGGGGSGGDIQMT QSPSSVSASVGDRV TITCRASQGISSWL AWYQQKPGKAPKLL IYAASSLQSGVPSR FSGSGSGTDFTLTI SSLQPEDFATYYCQ QANSFPLTFGGGTK VEIK (SEQ ID NO: 183) | CAGGTGCAGCTGGTGGAAAGCGGCGGAGGCCTGGTGAAACCT GGCGGCAGCCTGAGACTGAGCTGCGCCGCCAGCGGCTTCACC TTCAGCGACTACTACATGAGCTGGATCAGACAGGCCCCTGGC AAGGGACTGGAATGGGTGTCCTACATCAGCAGCAGCGGCTCG ACCATCTACTACGCCGACAGCGTGAAGGGCCGGTTCACCATC AGCCGGGACAACGCCAAGAACAGCCTGTACCTGCAGATGAAC AGCCTGCGGGCCGAGGACACCGCCGTGTATTACTGTGCGAGA TATATGTATAACTGGTACTTCGATCTCTGGGGCCGTGGCACC CTGGTCACTGTGTCCTCAGGCGGAGGTGGAAGCGGAGGGGGA GGATCTGGCGGCGGAGGAAGCGGAGGCGACATCCAGATGACC CAGAGCCCCAGCAGCGTGTCCGCCAGCGTGGGCGATCGAGTG ACCATCACCTGTCGGGCCTCCCAGGGCATCAGCAGCTGGCTG GCCTGGTATCAGCAGAAGCCCGGCAAGGCCCCCAAGCTGCTG ATCTACGCCGCCAGCAGCCTGCAGAGCGGCGTGCCAAGCAGA TTCAGCGGCAGCGGCTCCGGCACCGACTTCACCCTGACCATC AGCTCCCTGCAGCCCGAGGACTTCGCCACCTACTACTGCCAG CAGGCTAACAGTTTCCCTCTCACTTTCGGCGGCGGAACAAAG GTGGAGATCAAG (SEQ ID NO: 396) |
| 31 | QVQLVESGGGLVKP GGSLRLSCAASGFT FSDYYMSWIRQAPG KGLEWVSYISSSGS TIYYADSVKGRFTI SRDNAKNSLYLQMN SLRAEDTAVYYCAR DRRPAFDIWGQGTM VTVSSGGGGSGGG SGGGGSGGDIQMTQ SPSSVSASVGDRVT ITCRASQGISSWLA WYQQKPGKAPKLLI YAASSLQSGVPSRF SGSGSGTDFTLTIS SLQPEDFATYYCQQ ANSFPLTFGGGTKV EIK (SEQ ID NO: 184) | CAGGTGCAGCTGGTGGAAAGCGGCGGAGGCCTGGTGAAACCT GGCGGCAGCCTGAGACTGAGCTGCGCCGCCAGCGGCTTCACC TTCAGCGACTACTACATGAGCTGGATCAGACAGGCCCCTGGC AAGGGACTGGAATGGGTGTCCTACATCAGCAGCAGCGGCTCG ACCATCTACTACGCCGACAGCGTGAAGGGCCGGTTCACCATC AGCCGGGACAACGCCAAGAACAGCCTGTACCTGCAGATGAAC AGCCTGCGGGCCGAGGACACCGCCGTGTATTACTGTGCGAGA GATCGAAGGCCTGCTTTTGATATCTGGGGCCAAGGGACAATG GTCACCGTGTCCTCAGGCGGAGGTGGAAGCGGAGGGGGAGGA TCTGGCGGCGGAGGAAGCGGAGGCGACATCCAGATGACCCAG AGCCCCAGCAGCGTGTCCGCCAGCGTGGGCGATCGAGTGACC ATCACCTGTCGGGCCTCCCAGGGCATCAGCAGCTGGCTGGCC TGGTATCAGCAGAAGCCCGGCAAGGCCCCCAAGCTGCTGATC TACGCCGCCAGCAGCCTGCAGAGCGGCGTGCCAAGCAGATTC AGCGGCAGCGGCTCCGGCACCGACTTCACCCTGACCATCAGC CTGCAGCCCGAGGACTTCGCCACCTACTACTGCCAGCAG GCTAACAGTTTCCCTCTCACTTTCGGCGGCGGAACAAAGGTG GAGATCAAG (SEQ ID NO: 397) |
| 32 | QVQLVESGGGLVKP GGSLRLSCAASGFT FSDYYMSWIRQAPG KGLEWVSYISSSGS TIYYADSVKGRFTI SRDNAKNSLYLQMN SLRAEDTAVYYCAV HLKRRPYFDYWGQG | CAGGTGCAGCTGGTGGAAAGCGGCGGAGGCCTGGTGAAACCT GGCGGCAGCCTGAGACTGAGCTGCGCCGCCAGCGGCTTCACC TTCAGCGACTACTACATGAGCTGGATCAGACAGGCCCCTGGC AAGGGACTGGAATGGGTGTCCTACATCAGCAGCAGCGGCTCG ACCATCTACTACGCCGACAGCGTGAAGGGCCGGTTCACCATC AGCCGGGACAACGCCAAGAACAGCCTGTACCTGCAGATGAAC AGCCTGCGGGCCGAGGACACCGCCGTGTATTACTGTGCGGTA CATTTGAAACGACGTCCCTACTTTGACTACTGGGGCCAGGGA |

TABLE 1-continued

Exemplary MSLN scFv domains

| | Protein Sequence | DNA Sequence |
|---|---|---|
| | TLVTVSSGGGGSGG GGSGGGGSGGAIQL TQSPSSLSASVGDR VTITCRASQGISSA LAWYQQKPGKAPKL LIYDASSLESGVPS RFSGSGSGTDFTLT ISSLQPEDFATYYC QQFNSYPLTFGGGT KVEIK (SEQ ID NO: 185) | ACCCTGGTCACCGTGTCCTCAGGCGGAGGTGGAAGCGGAGGG GGAGGATCTGGCGGCGGAGGAAGCGGAGGCGCCATCCAGCTG ACCCAGAGCCCCAGCAGCCTGAGCGCCAGCGTGGGCGATAGA GTGACCATCACCTGTCGCGCCAGCCAGGGCATCAGCAGCGCT CTGGCCTGGTATCAGCAGAAGCCCGGCAAGGCCCCCAAGCTG CTGATCTACGACGCCAGCTCCCTGGAAAGCGGCGTGCCCAGC AGATTCAGCGGCAGCGGCTCCGGCACCGACTTCACCCTGACC ATCAGCAGCCTGCAGCCCGAGGACTTCGCCACCTACTACTGC CAGCAGTTTAATAGTTACCCTCTCACTTTCGGCGGCGGAACA AAGGTGGAGATCAAG (SEQ ID NO: 398) |
| 33 | QVQLVESGGGLVKP GGSLRLSCAASGFT FSDYYMSWIRQAPG KGLEWVSYISSSGS TIYYADSVKGRFTI SRDNAKNSLYLQMN SLRAEDTAVYYCAS VHKKPIFDYWGQGT LVTVSSGGGGSGGG GSGGGGSGGAIQLT QSPSSLSASVGDRV TITCRASQGISSAL AWYQQKPGKAPKLL IYDASSLESGVPSR FSGSGSGTDFTLTI SSLQPEDFATYYCQ QFNSYPLTFGGGTK VEIK (SEQ ID NO: 186) | CAGGTGCAGCTGGTGGAAAGCGGCGGAGGCCTGGTGAAACCT GGCGGCAGCCTGAGACTGAGCTGCGCCGCCAGCGGCTTCACC TTCAGCGACTACTACATGAGCTGGATCAGACAGGCCCCTGGC AAGGGACTGGAATGGGTGTCCTACATCAGCAGCAGCGGCTCG ACCATCTACTACGCCGACAGCGTGAAGGGCCGGTTCACCATC AGCCGGGACAACGCCAAGAACAGCCTGTACCTGCAGATGAAC AGCCTGCGGGCCGAGGACACCGCCGTGTATTACTGTGCGAGC GTACATAAGAAACCCATCTTTGACTACTGGGGCCAGGGAACC CTGGTCACCGTGTCCTCAGGCGGAGGTGGAAGCGGAGGGGGA GGATCTGGCGGCGGAGGAAGCGGAGGCGCCATCCAGCTGACC CAGAGCCCCAGCAGCCTGAGCGCCAGCGTGGGCGATAGAGTG ACCATCACCTGTCGCGCCAGCCAGGGCATCAGCAGCGCTCTG GCCTGGTATCAGCAGAAGCCCGGCAAGGCCCCCAAGCTGCTG ATCTACGACGCCAGCTCCCTGGAAAGCGGCGTGCCCAGCAGA TTCAGCGGCAGCGGCTCCGGCACCGACTTCACCCTGACCATC AGCAGCCTGCAGCCCGAGGACTTCGCCACCTACTACTGCCAG CAGTTTAATAGTTACCCTCTCACTTTCGGCGGCGGAACAAAG GTGGAGATCAAG (SEQ ID NO: 399) |
| 34 | QVQLVESGGGLVKP GGSLRLSCAASGFT FSDYYMSWIRQAPG KGLEWVSYISSSGS TIYYADSVKGRFTI SRDNAKNSLYLQMN SLRAEDTAVYYCAS TSRRCTFQHWGQGT LVTVSSGGGGSGGG GSGGGGSGGAIQLT QSPSSLSASVGDRV TITCRASQGISSAL AWYQQKPGKAPKLL IYDASSLESGVPSR FSGSGSGTDFTLTI SSLQPEDFATYYCQ QFNSYPLTFGGGTK VEIK (SEQ ID NO: 187) | CAGGTGCAGCTGGTGGAAAGCGGCGGAGGCCTGGTGAAACCT GGCGGCAGCCTGAGACTGAGCTGCGCCGCCAGCGGCTTCACC TTCAGCGACTACTACATGAGCTGGATCAGACAGGCCCCTGGC AAGGGACTGGAATGGGTGTCCTACATCAGCAGCAGCGGCTCG ACCATCTACTACGCCGACAGCGTGAAGGGCCGGTTCACCATC AGCCGGGACAACGCCAAGAACAGCCTGTACCTGCAGATGAAC AGCCTGCGGGCCGAGGACACCGCCGTGTATTACTGTGCGAGT ACCAGTCGGCGCTGTACCTTCCAGCACTGGGGCCAGGGCACC CTGGTCACCGTGTCCTCAGGCGGAGGTGGAAGCGGAGGGGGA GGATCTGGCGGCGGAGGAAGCGGAGGCGCCATCCAGCTGACC CAGAGCCCCAGCAGCCTGAGCGCCAGCGTGGGCGATAGAGTG ACCATCACCTGTCGCGCCAGCCAGGGCATCAGCAGCGCTCTG GCCTGGTATCAGCAGAAGCCCGGCAAGGCCCCCAAGCTGCTG ATCTACGACGCCAGCTCCCTGGAAAGCGGCGTGCCCAGCAGA TTCAGCGGCAGCGGCTCCGGCACCGACTTCACCCTGACCATC AGCAGCCTGCAGCCCGAGGACTTCGCCACCTACTACTGCCAG CAGTTTAATAGTTACCCTCTCACTTTCGGCGGCGGAACAAAG GTGGAGATCAAG (SEQ ID NO: 400) |
| 35 | QVQLVESGGGLVKP GGSLRLSCAASGFT FSDYYMSWIRQAPG KGLEWVSYISSSGS TIYYADSVKGRFTI SRDNAKNSLYLQMN SLRAEDTAVYYCAS TSPRPLFQHWGQGT LVTVSSGGGGSGGG GSGGGGSGGAIQLT QSPSSLSASVGDRV TITCRASQGISSAL AWYQQKPGKAPKLL IYDASSLESGVPSR FSGSGSGTDFTLTI SSLQPEDFATYYCQ QFNSYPLTFGGGTK VEIK (SEQ ID NO: 188) | CAGGTGCAGCTGGTGGAAAGCGGCGGAGGCCTGGTGAAACCT GGCGGCAGCCTGAGACTGAGCTGCGCCGCCAGCGGCTTCACC TTCAGCGACTACTACATGAGCTGGATCAGACAGGCCCCTGGC AAGGGACTGGAATGGGTGTCCTACATCAGCAGCAGCGGCTCG ACCATCTACTACGCCGACAGCGTGAAGGGCCGGTTCACCATC AGCCGGGACAACGCCAAGAACAGCCTGTACCTGCAGATGAAC AGCCTGCGGGCCGAGGACACCGCCGTGTATTACTGTGCGAGT ACCAGCCCGCGTCCTCTCTTCCAGCACTGGGGCCAGGGCACC CTGGTCACCGTGTCCTCAGGCGGAGGTGGAAGCGGAGGGGGA GGATCTGGCGGCGGAGGAAGCGGAGGCGCCATCCAGCTGACC CAGAGCCCCAGCAGCCTGAGCGCCAGCGTGGGCGATAGAGTG ACCATCACCTGTCGCGCCAGCCAGGGCATCAGCAGCGCTCTG GCCTGGTATCAGCAGAAGCCCGGCAAGGCCCCCAAGCTGCTG ATCTACGACGCCAGCTCCCTGGAAAGCGGCGTGCCCAGCAGA TTCAGCGGCAGCGGCTCCGGCACCGACTTCACCCTGACCATC AGCAGCCTGCAGCCCGAGGACTTCGCCACCTACTACTGCCAG CAGTTTAATAGTTACCCTCTCACTTTCGGCGGCGGAACAAAG GTGGAGATCAAG (SEQ ID NO: 401) |
| 36 | QVQLVESGGGLVKP GGSLRLSCAASGFT FSDYYMSWIRQAPG | CAGGTGCAGCTGGTGGAAAGCGGCGGAGGCCTGGTGAAACCT GGCGGCAGCCTGAGACTGAGCTGCGCCGCCAGCGGCTTCACC TTCAGCGACTACTACATGAGCTGGATCAGACAGGCCCCTGGC |

TABLE 1-continued

Exemplary MSLN scFv domains

| | Protein Sequence | DNA Sequence |
|---|---|---|
| | KGLEWVSYISSSGS TIYYADSVKGRFTI SRDNAKNSLYLQMN SLRAEDTAVYYCAS PYQVRGVYFDYWGQ GTLVTVSSGGGGSG GGSGGGGSGGAIQ LTQSPSSLSASVGD RVTITCRASQGISS ALAWYQQKPGKAPK LLIYDASSLESGVP SRFSGSGSGTDFTL TISSLQPEDFATYY CQQFNSYPLTFGGG TKVEIK (SEQ ID NO: 189) | AAGGGACTGGAATGGGTGTCCTACATCAGCAGCAGCGGCTCG ACCATCTACTACGCCGACAGCGTGAAGGGCCGGTTCACCATC AGCCGGGACAACGCCAAGAACAGCCTGTACCTGCAGATGAAC AGCCTGCGGGCCGAGGACACCGCCGTGTATTACTGTGCGAGC CCTTACCAAGTCCGAGGAGTCTACTTTGACTACTGGGGCCAG GGAACCCTGGTCACCGTGTCCTCAGGCGGAGGTGGAAGCGGA GGGGGAGGATCTGGCGGCGGAGGAAGCGGAGGCGCCATCCAG CTGACCCAGAGCCCCAGCAGCCTGAGCGCCAGCGTGGGCGAT AGAGTGACCATCACCTGTCGCGCCAGCCAGGGCATCAGCAGC GCTCTGGCCTGGTATCAGCAGAAGCCCGGCAAGGCCCCCAAG CTGCTGATCTACGACGCCAGCTCCCTGGAAAGCGGCGTGCCC AGCAGATTCAGCGGCAGCGGCTCCGGCACCGACTTCACCCTG ACCATCAGCAGCCTGCAGCCCGAGGACTTCGCCACCTACTAC TGCCAGCAGTTTAATAGTTACCCTCTCACTTTCGGCGGCGGA ACAAAGGTGGAGATCAAG (SEQ ID NO: 402) |
| 37 | QVQLVESGGGLVKP GGSLRLSCAASGFT FSDYYMSWIRQAPG KGLEWVSYISSSGS TIYYADSVKGRFTI SRDNAKNSLYLQMN SLRAEDTAVYYCAS PYKKRRTVFDYWGQ GTLVTVSSGGGGSG GGSGGGGSGGAIQ LTQSPSSLSASVGD RVTITCRASQGISS ALAWYQQKPGKAPK LLIYDASSLESGVP SRFSGSGSGTDFTL TISSLQPEDFATYY CQQFNSYPLTFGGG TKVEIK (SEQ ID NO: 190) | CAGGTGCAGCTGGTGGAAAGCGGCGGAGGCCTGGTGAAACCT GGCGGCAGCCTGAGACTGAGCTGCGCCGCCAGCGGCTTCACC TTCAGCGACTACTACATGAGCTGGATCAGACAGGCCCCTGGC AAGGGACTGGAATGGGTGTCCTACATCAGCAGCAGCGGCTCG ACCATCTACTACGCCGACAGCGTGAAGGGCCGGTTCACCATC AGCCGGGACAACGCCAAGAACAGCCTGTACCTGCAGATGAAC AGCCTGCGGGCCGAGGACACCGCCGTGTATTACTGTGCGAGC CCCTATAAGAAACGACGAACGGTCTTTGACTACTGGGGCCAG GGAACCCTGGTCACCGTGTCCTCAGGCGGAGGTGGAAGCGGA GGGGGAGGATCTGGCGGCGGAGGAAGCGGAGGCGCCATCCAG CTGACCCAGAGCCCCAGCAGCCTGAGCGCCAGCGTGGGCGAT AGAGTGACCATCACCTGTCGCGCCAGCCAGGGCATCAGCAGC GCTCTGGCCTGGTATCAGCAGAAGCCCGGCAAGGCCCCCAAG CTGCTGATCTACGACGCCAGCTCCCTGGAAAGCGGCGTGCCC AGCAGATTCAGCGGCAGCGGCTCCGGCACCGACTTCACCCTG ACCATCAGCAGCCTGCAGCCCGAGGACTTCGCCACCTACTAC TGCCAGCAGTTTAATAGTTACCCTCTCACTTTCGGCGGCGGA ACAAAGGTGGAGATCAAG (SEQ ID NO: 403) |
| 38 | QVQLVESGGGLVKP GGSLRLSCAASGFT FSDYYMSWIRQAPG KGLEWVSYISSSGS TIYYADSVKGRFTI SRDNAKNSLYLQMN SLRAEDTAVYYCAS LQRGLALFQHWGQG TLVTVSSGGGGSGG GGSGGGGSGGAIQL TQSPSSLSASVGDR VTITCRASQGISSA LAWYQQKPGKAPKL LIYDASSLESGVPS RFSGSGSGTDFTLT ISSLQPEDFATYYC QQFNSYPLTFGGGT KVEIK (SEQ ID NO: 191) | CAGGTGCAGCTGGTGGAAAGCGGCGGAGGCCTGGTGAAACCT GGCGGCAGCCTGAGACTGAGCTGCGCCGCCAGCGGCTTCACC TTCAGCGACTACTACATGAGCTGGATCAGACAGGCCCCTGGC AAGGGACTGGAATGGGTGTCCTACATCAGCAGCAGCGGCTCG ACCATCTACTACGCCGACAGCGTGAAGGGCCGGTTCACCATC AGCCGGGACAACGCCAAGAACAGCCTGTACCTGCAGATGAAC AGCCTGCGGGCCGAGGACACCGCCGTGTATTACTGTGCGTCT TTACAGCGCGGGCTGGCCCTCTTCCAGCACTGGGGCCAGGGC ACCCTGGTCACCGTGTCCTCAGGCGGAGGTGGAAGCGGAGGG GGAGGATCTGGCGGCGGAGGAAGCGGAGGCGCCATCCAGCTG ACCCAGAGCCCCAGCAGCCTGAGCGCCAGCGTGGGCGATAGA GTGACCATCACCTGTCGCGCCAGCCAGGGCATCAGCAGCGCT CTGGCCTGGTATCAGCAGAAGCCCGGCAAGGCCCCCAAGCTG CTGATCTACGACGCCAGCTCCCTGGAAAGCGGCGTGCCCAGC AGATTCAGCGGCAGCGGCTCCGGCACCGACTTCACCCTGACC ATCAGCAGCCTGCAGCCCGAGGACTTCGCCACCTACTACTGC CAGCAGTTTAATAGTTACCCTCTCACTTTCGGCGGCGGAACA AAGGTGGAGATCAAG (SEQ ID NO: 404) |
| 39 | QVQLVESGGGLVKP GGSLRLSCAASGFT FSDYYMSWIRQAPG KGLEWVSYISSSGS TIYYADSVKGRFTI SRDNAKNSLYLQMN SLRAEDTAVYYCAS ILSVPYFDLWGRGT LVTVSSGGGGSGGG GSGGGGSGGAIQLT QSPSSLSASVGDRV TITCRASQGISSAL AWYQQKPGKAPKLL IYDASSLESGVPSR | CAGGTGCAGCTGGTGGAAAGCGGCGGAGGCCTGGTGAAACCT GGCGGCAGCCTGAGACTGAGCTGCGCCGCCAGCGGCTTCACC TTCAGCGACTACTACATGAGCTGGATCAGACAGGCCCCTGGC AAGGGACTGGAATGGGTGTCCTACATCAGCAGCAGCGGCTCG ACCATCTACTACGCCGACAGCGTGAAGGGCCGGTTCACCATC AGCCGGGACAACGCCAAGAACAGCCTGTACCTGCAGATGAAC AGCCTGCGGGCCGAGGACACCGCCGTGTATTACTGTGCTAGC ATATTGTCAGTTCCGTACTTCGATCTCTGGGGCCGTGGCACC CTGGTCACTGTGTCCTCAGGCGGAGGTGGAAGCGGAGGGGGA GGATCTGGCGGCGGAGGAAGCGGAGGCGCCATCCAGCTGACC CAGAGCCCCAGCAGCCTGAGCGCCAGCGTGGGCGATAGAGTG ACCATCACCTGTCGCGCCAGCCAGGGCATCAGCAGCGCTCTG GCCTGGTATCAGCAGAAGCCCGGCAAGGCCCCCAAGCTGCTG ATCTACGACGCCAGCTCCCTGGAAAGCGGCGTGCCCAGCAGA |

TABLE 1-continued

Exemplary MSLN scFv domains

| Protein Sequence | DNA Sequence |
|---|---|
| FSGSGSGTDFTLTI SSLQPEDFATYYCQ QFNSYPLTFGGGTK VEIK (SEQ ID NO: 192) | TTCAGCGGCAGCGGCTCCGGCACCGACTTCACCCTGACCATC AGCAGCCTGCAGCCCGAGGACTTCGCCACCTACTACTGCCAG CAGTTTAATAGTTACCCTCTCACTTTCGGCGGCGGAACAAAG GTGGAGATCAAG (SEQ ID NO: 405) |
| 40 QVQLVESGGGLVKP GGSLRLSCAASGFT FSDYYMSWIRQAPG KGLEWVSYISSSGS TIYYADSVKGRFTI SRDNAKNSLYLQMN SLRAEDTAVYYCAS GWIRVPLRLPLFQH WGQGTLVTVSSGGG GSGGGGSGGGGSGG AIQLTQSPSSLSAS VGDRVTITCRASQG ISSALAWYQQKPGK APKLLIYDASSLES GVPSRFSGSGSGTD FTLTISSLQPEDFA TYYCQQFNSYPLTF GGGTKVEIK (SEQ ID NO: 193) | CAGGTGCAGCTGGTGGAAAGCGGCGGAGGCCTGGTGAAACCT GGCGGCAGCCTGAGACTGAGCTGCGCCGCCAGCGGCTTCACC TTCAGCGACTACTACATGAGCTGGATCAGACAGGCCCCTGGC AAGGGACTGGAATGGGTGTCCTACATCAGCAGCAGCGGCTCG ACCATCTACTACGCCGACAGCGTGAAGGGCCGGTTCACCATC AGCCGGGACAACGCCAAGAACAGCCTGTACCTGCAGATGAAC AGCCTGCGGGCCGAGGACACCGCCGTGTATTACTGTGCGAGT GGGTGGATTCGTGTACCTTTACGATTGCCCCTCTTCCAGCAC TGGGGCCAGGGCACCCTGGTCACCGTGTCCTCAGGCGGAGGT GGAAGCGGAGGGGGAGGATCTGGCGGCGGAGGAAGCGGAGGC GCCATCCAGCTGACCCAGAGCCCCAGCAGCCTGAGCGCCAGC GTGGGCGATAGAGTGACCATCACCTGTCGCGCCAGCCAGGGC ATCAGCAGCGCTCTGGCCTGGTATCAGCAGAAGCCCGGCAAG GCCCCCAAGCTGCTGATCTACGACGCCAGCTCCCTGGAAAGC GGCGTGCCCAGCAGATTCAGCGGCAGCGGCTCCGGCACCGAC TTCACCCTGACCATCAGCAGCCTGCAGCCCGAGGACTTCGCC ACCTACTACTGCCAGCAGTTTAATAGTTACCCTCTCACTTTC GGCGGCGGAACAAAGGTGGAGATCAAG (SEQ ID NO: 406) |
| 41 QVQLVESGGGLVKP GGSLRLSCAASGFT FSDYYMSWIRQAPG KGLEWVSYISSSGS TIYYADSVKGRFTI SRDNAKNSLYLQMN SLRAEDTAVYYCAR VTIFAIFDIWGQGT MVTVSSGGGGSGGG GSGGGGSGGAIQLT QSPSSLSASVGDRV TITCRASQGISSAL AWYQQKPGKAPKLL IYDASSLESGVPSR FSGSGSGTDFTLTI SSLQPEDFATYYCQ QFNSYPLTFGGGTK VEIK (SEQ ID NO: 194) | CAGGTGCAGCTGGTGGAAAGCGGCGGAGGCCTGGTGAAACCT GGCGGCAGCCTGAGACTGAGCTGCGCCGCCAGCGGCTTCACC TTCAGCGACTACTACATGAGCTGGATCAGACAGGCCCCTGGC AAGGGACTGGAATGGGTGTCCTACATCAGCAGCAGCGGCTCG ACCATCTACTACGCCGACAGCGTGAAGGGCCGGTTCACCATC AGCCGGGACAACGCCAAGAACAGCCTGTACCTGCAGATGAAC AGCCTGCGGGCCGAGGACACCGCCGTGTATTACTGTGCGAGA GTAACCATATTTGCGATATTTGATATCTGGGGCCAAGGGACA ATGGTCACCGTGTCCTCAGGCGGAGGTGGAAGCGGAGGGGGA GGATCTGGCGGCGGAGGAAGCGGAGGCGCCATCCAGCTGACC CAGAGCCCCAGCAGCCTGAGCGCCAGCGTGGGCGATAGAGTG ACCATCACCTGTCGCGCCAGCCAGGGCATCAGCAGCGCTCTG GCCTGGTATCAGCAGAAGCCCGGCAAGGCCCCCAAGCTGCTG ATCTACGACGCCAGCTCCCTGGAAAGCGGCGTGCCCAGCAGA TTCAGCGGCAGCGGCTCCGGCACCGACTTCACCCTGACCATC AGCAGCCTGCAGCCCGAGGACTTCGCCACCTACTACTGCCAG CAGTTTAATAGTTACCCTCTCACTTTCGGCGGCGGAACAAAG GTGGAGATCAAG (SEQ ID NO: 407) |
| 42 QVQLVESGGGLVKP GGSLRLSCAASGFT FSDYYMSWIRQAPG KGLEWVSYISSSGS TIYYADSVKGRFTI SRDNAKNSLYLQMN SLRAEDTAVYYCAR VGRGFVHFDLWGRG TLVTVSSGGGGSGG GGSGGGGSGGAIQL TQSPSSLSASVGDR VTITCRASQGISSA LAWYQQKPGKAPKL LIYDASSLESGVPS RFSGSGSGTDFTLT ISSLQPEDFATYYC QQFNSYPLTFGGGT KVEIK (SEQ ID NO: 195) | CAGGTGCAGCTGGTGGAAAGCGGCGGAGGCCTGGTGAAACCT GGCGGCAGCCTGAGACTGAGCTGCGCCGCCAGCGGCTTCACC TTCAGCGACTACTACATGAGCTGGATCAGACAGGCCCCTGGC AAGGGACTGGAATGGGTGTCCTACATCAGCAGCAGCGGCTCG ACCATCTACTACGCCGACAGCGTGAAGGGCCGGTTCACCATC AGCCGGGACAACGCCAAGAACAGCCTGTACCTGCAGATGAAC AGCCTGCGGGCCGAGGACACCGCCGTGTATTACTGTGCGAGA GTGGGACGTGGATTCGTTCATTTTGATCTCTGGGGCCGTGGC ACCCTGGTCACTGTGTCCTCAGGCGGAGGTGGAAGCGGAGGG GGAGGATCTGGCGGCGGAGGAAGCGGAGGCGCCATCCAGCTG ACCCAGAGCCCCAGCAGCCTGAGCGCCAGCGTGGGCGATAGA GTGACCATCACCTGTCGCGCCAGCCAGGGCATCAGCAGCGCT CTGGCCTGGTATCAGCAGAAGCCCGGCAAGGCCCCCAAGCTG CTGATCTACGACGCCAGCTCCCTGGAAAGCGGCGTGCCCAGC AGATTCAGCGGCAGCGGCTCCGGCACCGACTTCACCCTGACC ATCAGCAGCCTGCAGCCCGAGGACTTCGCCACCTACTACTGC CAGCAGTTTAATAGTTACCCTCTCACTTTCGGCGGCGGAACA AAGGTGGAGATCAAG (SEQ ID NO: 408) |
| 43 QVQLVESGGGLVKP GGSLRLSCAASGFT FSDYYMSWIRQAPG KGLEWVSYISSSGS TIYYADSVKGRFTI SRDNAKNSLYLQMN SLRAEDTAVYYCAR TSRGLCVLFDYWGQ GTLVTVSSGGGGSG | CAGGTGCAGCTGGTGGAAAGCGGCGGAGGCCTGGTGAAACCT GGCGGCAGCCTGAGACTGAGCTGCGCCGCCAGCGGCTTCACC TTCAGCGACTACTACATGAGCTGGATCAGACAGGCCCCTGGC AAGGGACTGGAATGGGTGTCCTACATCAGCAGCAGCGGCTCG ACCATCTACTACGCCGACAGCGTGAAGGGCCGGTTCACCATC AGCCGGGACAACGCCAAGAACAGCCTGTACCTGCAGATGAAC AGCCTGCGGGCCGAGGACACCGCCGTGTATTACTGTGCGAGG ACGTCAAGAGGTTTGTGTGTTTTATTTGACTACTGGGGCCAG GGAACCCTGGTCACCGTGTCCTCAGGCGGAGGTGGAAGCGGA |

TABLE 1-continued

Exemplary MSLN scFv domains

| | Protein Sequence | DNA Sequence |
|---|---|---|
| | GGGSGGGGSGGAIQ LTQSPSSLSASVGD RVTITCRASQGISS ALAWYQQKPGKAPK LLIYDASSLESGVP SRFSGSGSGTDFTL TISSLQPEDFATYY CQQFNSYPLTFGGG TKVEIK (SEQ ID NO: 196) | GGGGGAGGATCTGGCGGCGGAGGAAGCGGAGGCGCCATCCAG CTGACCCAGAGCCCCAGCAGCCTGAGCGCCAGCGTGGGCGAT AGAGTGACCATCACCTGTCGCGCCAGCCAGGGCATCAGCAGC GCTCTGGCCTGGTATCAGCAGAAGCCCGGCAAGGCCCCCAAG CTGCTGATCTACGACGCCAGCTCCCTGGAAAGCGGCGTGCCC AGCAGATTCAGCGGCAGCGGCTCCGGCACCGACTTCACCCTG ACCATCAGCAGCCTGCAGCCCGAGGACTTCGCCACCTACTAC TGCCAGCAGTTTAATAGTTACCCTCTCACTTTCGGCGGCGGA ACAAAGGTGGAGATCAAG (SEQ ID NO: 409) |
| 44 | QVQLVESGGGLVKP GGSLRLSCAASGFT FSDYYMSWIRQAPG KGLEWVSYISSSGS TIYYADSVKGRFTI SRDNAKNSLYLQMN SLRAEDTAVYYCAR SGPSSYWYFDLWGR GTLVTVSSGGGGSG GGGSGGGGSGGAIQ LTQSPSSLSASVGD RVTITCRASQGISS ALAWYQQKPGKAPK LLIYDASSLESGVP SRFSGSGSGTDFTL TISSLQPEDFATYY CQQFNSYPLTFGGG TKVEIK (SEQ ID NO: 197) | CAGGTGCAGCTGGTGGAAAGCGGCGGAGGCCTGGTGAAACCT GGCGGCAGCCTGAGACTGAGCTGCGCCGCCAGCGGCTTCACC TTCAGCGACTACTACATGAGCTGGATCAGACAGGCCCCTGGC AAGGGACTGGAATGGGTGTCCTACATCAGCAGCAGCGGCTCG ACCATCTACTACGCCGACAGCGTGAAGGGCCGGTTCACCATC AGCCGGGACAACGCCAAGAACAGCCTGTACCTGCAGATGAAC AGCCTGCGGGCCGAGGACACCGCCGTGTATTACTGTGCGAGA AGTGGGCCCAGTAGCTACTGGTACTTCGATCTCTGGGGCCGT GGCACCCTGGTCACTGTGTCCTCAGGCGGAGGTGGAAGCGGA GGGGGAGGATCTGGCGGCGGAGGAAGCGGAGGCGCCATCCAG CTGACCCAGAGCCCCAGCAGCCTGAGCGCCAGCGTGGGCGAT AGAGTGACCATCACCTGTCGCGCCAGCCAGGGCATCAGCAGC GCTCTGGCCTGGTATCAGCAGAAGCCCGGCAAGGCCCCCAAG CTGCTGATCTACGACGCCAGCTCCCTGGAAAGCGGCGTGCCC AGCAGATTCAGCGGCAGCGGCTCCGGCACCGACTTCACCCTG ACCATCAGCAGCCTGCAGCCCGAGGACTTCGCCACCTACTAC TGCCAGCAGTTTAATAGTTACCCTCTCACTTTCGGCGGCGGA ACAAAGGTGGAGATCAAG (SEQ ID NO: 410) |
| 45 | QVQLVESGGGLVKP GGSLRLSCAASGFT FSDYYMSWIRQAPG KGLEWVSYISSSGS TIYYADSVKGRFTI SRDNAKNSLYLQMN SLRAEDTAVYYCAR NIYMGGIWFDPWGQ GTLVTVSSGGGGSG GGGSGGGGSGGAIQ LTQSPSSLSASVGD RVTITCRASQGISS ALAWYQQKPGKAPK LLIYDASSLESGVP SRFSGSGSGTDFTL TISSLQPEDFATYY CQQFNSYPLTFGGG TKVEIK (SEQ ID NO: 198) | CAGGTGCAGCTGGTGGAAAGCGGCGGAGGCCTGGTGAAACCT GGCGGCAGCCTGAGACTGAGCTGCGCCGCCAGCGGCTTCACC TTCAGCGACTACTACATGAGCTGGATCAGACAGGCCCCTGGC AAGGGACTGGAATGGGTGTCCTACATCAGCAGCAGCGGCTCG ACCATCTACTACGCCGACAGCGTGAAGGGCCGGTTCACCATC AGCCGGGACAACGCCAAGAACAGCCTGTACCTGCAGATGAAC AGCCTGCGGGCCGAGGACACCGCCGTGTATTACTGTGCGAGA AACATTTACATGGGCGGGATCTGGTTCGACCCCTGGGGCCAG GGAACCCTGGTCACCGTGTCCTCAGGCGGAGGTGGAAGCGGA GGGGGAGGATCTGGCGGCGGAGGAAGCGGAGGCGCCATCCAG CTGACCCAGAGCCCCAGCAGCCTGAGCGCCAGCGTGGGCGAT AGAGTGACCATCACCTGTCGCGCCAGCCAGGGCATCAGCAGC GCTCTGGCCTGGTATCAGCAGAAGCCCGGCAAGGCCCCCAAG CTGCTGATCTACGACGCCAGCTCCCTGGAAAGCGGCGTGCCC AGCAGATTCAGCGGCAGCGGCTCCGGCACCGACTTCACCCTG ACCATCAGCAGCCTGCAGCCCGAGGACTTCGCCACCTACTAC TGCCAGCAGTTTAATAGTTACCCTCTCACTTTCGGCGGCGGA ACAAAGGTGGAGATCAAG (SEQ ID NO: 411) |
| 46 | QVQLVESGGGLVKP GGSLRLSCAASGFT FSDYYMSWIRQAPG KGLEWVSYISSSGS TIYYADSVKGRFTI SRDNAKNSLYLQMN SLRAEDTAVYYCAR LTVRTGAFDIWGQG TMVTVSSGGGGSGG GGSGGGGSGGAIQL TQSPSSLSASVGDR VTITCRASQGISSA LAWYQQKPGKAPKL LIYDASSLESGVPS RFSGSGSGTDFTLT ISSLQPEDFATYYC QQFNSYPLTFGGGT KVEIK (SEQ ID NO: 199) | CAGGTGCAGCTGGTGGAAAGCGGCGGAGGCCTGGTGAAACCT GGCGGCAGCCTGAGACTGAGCTGCGCCGCCAGCGGCTTCACC TTCAGCGACTACTACATGAGCTGGATCAGACAGGCCCCTGGC AAGGGACTGGAATGGGTGTCCTACATCAGCAGCAGCGGCTCG ACCATCTACTACGCCGACAGCGTGAAGGGCCGGTTCACCATC AGCCGGGACAACGCCAAGAACAGCCTGTACCTGCAGATGAAC AGCCTGCGGGCCGAGGACACCGCCGTGTATTACTGTGCGAGA CTTACAGTCCGCACTGGAGCTTTTGATATCTGGGGCCAAGGG ACAATGGTCACCGTGTCCTCAGGCGGAGGTGGAAGCGGAGGG GGAGGATCTGGCGGCGGAGGAAGCGGAGGCGCCATCCAGCTG ACCCAGAGCCCCAGCAGCCTGAGCGCCAGCGTGGGCGATAGA GTGACCATCACCTGTCGCGCCAGCCAGGGCATCAGCAGCGCT CTGGCCTGGTATCAGCAGAAGCCCGGCAAGGCCCCCAAGCTG CTGATCTACGACGCCAGCTCCCTGGAAAGCGGCGTGCCCAGC AGATTCAGCGGCAGCGGCTCCGGCACCGACTTCACCCTGACC ATCAGCAGCCTGCAGCCCGAGGACTTCGCCACCTACTACTGC CAGCAGTTTAATAGTTACCCTCTCACTTTCGGCGGCGGAACA AAGGTGGAGATCAAG (SEQ ID NO: 412) |
| 47 | QVQLVESGGGLVKP GGSLRLSCAASGFT FSDYYMSWIRQAPG KGLEWVSYISSSGS | CAGGTGCAGCTGGTGGAAAGCGGCGGAGGCCTGGTGAAACCT GGCGGCAGCCTGAGACTGAGCTGCGCCGCCAGCGGCTTCACC TTCAGCGACTACTACATGAGCTGGATCAGACAGGCCCCTGGC AAGGGACTGGAATGGGTGTCCTACATCAGCAGCAGCGGCTCG |

TABLE 1-continued

Exemplary MSLN scFv domains

| | Protein Sequence | DNA Sequence |
|---|---|---|
| | TIYYADSVKGRFTI SRDNAKNSLYLQMN SLRAEDTAVYYCAR LRTAHLDFDLWGRG TLVTVSSGGGGSGG GGSGGGGSGGAIQL TQSPSSLSASVGDR VTITCRASQGISSA LAWYQQKPGKAPKL LIYDASSLESGVPS RFSGSGSGTDFTLT ISSLQPEDFATYYC QQFNSYPLTFGGGT KVEIK (SEQ ID NO: 200) | ACCATCTACTACGCCGACAGCGTGAAGGGCCGGTTCACCATC AGCCGGGACAACGCCAAGAACAGCCTGTACCTGCAGATGAAC AGCCTGCGGGCCGAGGACACCGCCGTGTATTACTGTGCGAGA CTAAGAACTGCCCACCTGGACTTCGATCTCTGGGGCCGTGGC ACCCTGGTCACTGTGTCCTCAGGCGGAGGTGGAAGCGGAGGG GGAGGATCTGGCGGCGGAGGAAGCGGAGGCGCCATCCAGCTG ACCCAGAGCCCCAGCAGCCTGAGCGCCAGCGTGGGCGATAGA GTGACCATCACCTGTCGCGCCAGCCAGGGCATCAGCAGCGCT CTGGCCTGGTATCAGCAGAAGCCCGGCAAGGCCCCCAAGCTG CTGATCTACGACGCCAGCTCCCTGGAAAGCGGCGTGCCCAGC AGATTCAGCGGCAGCGGCTCCGGCACCGACTTCACCCTGACC ATCAGCAGCCTGCAGCCCGAGGACTTCGCCACCTACTACTGC CAGCAGTTTAATAGTTACCCTCTCACTTTCGGCGGCGGAACA AAGGTGGAGATCAAG (SEQ ID NO: 413) |
| 48 | QVQLVESGGGLVKP GGSLRLSCAASGFT FSDYYMSWIRQAPG KGLEWVSYISSSGS TIYYADSVKGRFTI SRDNAKNSLYLQMN SLRAEDTAVYYCAR DLIFPVVFDYWGQG TLVTVSSGGGGSGG GGSGGGGSGGAIQL TQSPSSLSASVGDR VTITCRASQGISSA LAWYQQKPGKAPKL LIYDASSLESGVPS RFSGSGSGTDFTLT ISSLQPEDFATYYC QQFNSYPLTFGGGT KVEIK (SEQ ID NO: 201) | CAGGTGCAGCTGGTGGAAAGCGGCGGAGGCCTGGTGAAACCT GGCGGCAGCCTGAGACTGAGCTGCGCCGCCAGCGGCTTCACC TTCAGCGACTACTACATGAGCTGGATCAGACAGGCCCCTGGC AAGGGACTGGAATGGGTGTCCTACATCAGCAGCAGCGGCTCG ACCATCTACTACGCCGACAGCGTGAAGGGCCGGTTCACCATC AGCCGGGACAACGCCAAGAACAGCCTGTACCTGCAGATGAAC AGCCTGCGGGCCGAGGACACCGCCGTGTATTACTGTGCGAGA GATCTCATATTTCCAGTAGTCTTTGACTACTGGGGCCAGGGA ACCCTGGTCACCGTGTCCTCAGGCGGAGGTGGAAGCGGAGGG GGAGGATCTGGCGGCGGAGGAAGCGGAGGCGCCATCCAGCTG ACCCAGAGCCCCAGCAGCCTGAGCGCCAGCGTGGGCGATAGA GTGACCATCACCTGTCGCGCCAGCCAGGGCATCAGCAGCGCT CTGGCCTGGTATCAGCAGAAGCCCGGCAAGGCCCCCAAGCTG CTGATCTACGACGCCAGCTCCCTGGAAAGCGGCGTGCCCAGC AGATTCAGCGGCAGCGGCTCCGGCACCGACTTCACCCTGACC ATCAGCAGCCTGCAGCCCGAGGACTTCGCCACCTACTACTGC CAGCAGTTTAATAGTTACCCTCTCACTTTCGGCGGCGGAACA AAGGTGGAGATCAAG (SEQ ID NO: 414) |
| 49 | QVQLVESGGGLVKP GGSLRLSCAASGFT FSDYYMSWIRQAPG KGLEWVSYISSSGS TIYYADSVKGRFTI SRDNAKNSLYLQMN SLRAEDTAVYYCAR DGYRKYGYVFFDIW GQGTMVTVSSGGGG SGGGGSGGGGSGGA IQLTQSPSSLSASV GDRVTITCRASQGI SSALAWYQQKPGKA PKLLIYDASSLESG VPSRFSGSGSGTDF TLTISSLQPEDFAT YYCQQFNSYPLTFG GGTKVEIK (SEQ ID NO: 202) | CAGGTGCAGCTGGTGGAAAGCGGCGGAGGCCTGGTGAAACCT GGCGGCAGCCTGAGACTGAGCTGCGCCGCCAGCGGCTTCACC TTCAGCGACTACTACATGAGCTGGATCAGACAGGCCCCTGGC AAGGGACTGGAATGGGTGTCCTACATCAGCAGCAGCGGCTCG ACCATCTACTACGCCGACAGCGTGAAGGGCCGGTTCACCATC AGCCGGGACAACGCCAAGAACAGCCTGTACCTGCAGATGAAC AGCCTGCGGGCCGAGGACACCGCCGTGTATTACTGTGCGAGA GATGGATATCGCAAATATGGTTACGTATTTTTTGATATCTGG GGCCAAGGGACAATGGTCACCGTGTCCTCAGGCGGAGGTGGA AGCGGAGGGGGAGGATCTGGCGGCGGAGGAAGCGGAGGCGCC ATCCAGCTGACCCAGAGCCCCAGCAGCCTGAGCGCCAGCGTG GGCGATAGAGTGACCATCACCTGTCGCGCCAGCCAGGGCATC AGCAGCGCTCTGGCCTGGTATCAGCAGAAGCCCGGCAAGGCC CCCAAGCTGCTGATCTACGACGCCAGCTCCCTGGAAAGCGGC GTGCCCAGCAGATTCAGCGGCAGCGGCTCCGGCACCGACTTC ACCCTGACCATCAGCAGCCTGCAGCCCGAGGACTTCGCCACC TACTACTGCCAGCAGTTTAATAGTTACCCTCTCACTTTCGGC GGCGGAACAAAGGTGGAGATCAAG (SEQ ID NO: 415) |
| 50 | QVQLVESGGGLVKP GGSLRLSCAASGFT FSDYYMSWIRQAPG KGLEWVSYISSSGS TIYYADSVKGRFTI SRDNAKNSLYLQMN SLRAEDTAVYYCAR DGRYRRFWHAFDIW GQGTMVTVSSGGGG SGGGGSGGGGSGGA IQLTQSPSSLSASV GDRVTITCRASQGI SSALAWYQQKPGKA PKLLIYDASSLESG | CAGGTGCAGCTGGTGGAAAGCGGCGGAGGCCTGGTGAAACCT GGCGGCAGCCTGAGACTGAGCTGCGCCGCCAGCGGCTTCACC TTCAGCGACTACTACATGAGCTGGATCAGACAGGCCCCTGGC AAGGGACTGGAATGGGTGTCCTACATCAGCAGCAGCGGCTCG ACCATCTACTACGCCGACAGCGTGAAGGGCCGGTTCACCATC AGCCGGGACAACGCCAAGAACAGCCTGTACCTGCAGATGAAC AGCCTGCGGGCCGAGGACACCGCCGTGTATTACTGTGCGAGA GATGGGAGGTACAGGCGGTTCTGGCATGCTTTTGATATCTGG GGCCAAGGGACAATGGTCACCGTGTCCTCAGGCGGAGGTGGA AGCGGAGGGGGAGGATCTGGCGGCGGAGGAAGCGGAGGCGCC ATCCAGCTGACCCAGAGCCCCAGCAGCCTGAGCGCCAGCGTG GGCGATAGAGTGACCATCACCTGTCGCGCCAGCCAGGGCATC AGCAGCGCTCTGGCCTGGTATCAGCAGAAGCCCGGCAAGGCC CCCAAGCTGCTGATCTACGACGCCAGCTCCCTGGAAAGCGGC |

TABLE 1-continued

Exemplary MSLN scFv domains

| Protein Sequence | DNA Sequence |
|---|---|
| VPSRFSGSGSGTDF TLTISSLQPEDFAT YYCQQFNSYPLTFG GGTKVEIK (SEQ ID NO: 203) | GTGCCCAGCAGATTCAGCGGCAGCGGCTCCGGCACCGACTTC ACCCTGACCATCAGCAGCCTGCAGCCCGAGGACTTCGCCACC TACTACTGCCAGCAGTTTAATAGTTACCCTCTCACTTTCGGC GGCGGAACAAAGGTGGAGATCAAG (SEQ ID NO: 416) |
| 51 QVQLVESGGGLVKP GGSLRLSCAASGFT FSDYYMSWIRQAPG KGLEWVSYISSSGS TIYYADSVKGRFTI SRDNAKNSLYLQMN SLRAEDTAVYYCAR AHIRGYFDLWGRGT LVTVSSGGGGSGGG GSGGGGSGGAIQLT QSPSSLSASVGDRV TITCRASQGISSAL AWYQQKPGKAPKLL IYDASSLESGVPSR FSGSGSGTDFTLTI SSLQPEDFATYYCQ QFNSYPLTFGGGTK VEIK (SEQ ID NO: 204) | CAGGTGCAGCTGGTGGAAAGCGGCGGAGGCCTGGTGAAACCT GGCGGCAGCCTGAGACTGAGCTGCGCCGCCAGCGGCTTCACC TTCAGCGACTACTACATGAGCTGGATCAGACAGGCCCCTGGC AAGGGACTGGAATGGGTGTCCTACATCAGCAGCAGCGGCTCG ACCATCTACTACGCCGACAGCGTGAAGGGCCGGTTCACCATC AGCCGGGACAACGCCAAGAACAGCCTGTACCTGCAGATGAAC AGCCTGCGGGCCGAGGACACCGCCGTGTATTACTGTGCGAGA GCCCATATACGGGGGTACTTCGATCTCTGGGGCCGTGGCACC CTGGTCACTGTGTCCTCAGGCGGAGGTGGAAGCGGAGGGGGA GGATCTGGCGGCGGAGGAAGCGGGGCCATCCAGCTGACC CAGAGCCCCAGCAGCCTGAGCGCCAGCGTGGGCGATAGAGTG ACCATCACCTGTCGCGCCAGCCAGGGCATCAGCAGCGCTCTG GCCTGGTATCAGCAGAAGCCCGGCAAGGCCCCCAAGCTGCTG ATCTACGACGCCAGCTCCCTGGAAAGCGGCGTGCCCAGCAGA TTCAGCGGCAGCGGCTCCGGCACCGACTTCACCCTGACCATC AGCAGCCTGCAGCCCGAGGACTTCGCCACCTACTACTGCCAG CAGTTTAATAGTTACCCTCTCACTTTCGGCGGCGGAACAAAG GTGGAGATCAAG (SEQ ID NO: 417) |
| 52 EVQLLESGGGLVQP GGSLRLSCAASGFT FSSYAMSWVRQAPG KGLEWVSAISGSGG STYYADSVKGRFTI SRDNSKNTLYLQMN SLRAEDTAVYYCAT WMGGGGRWYFDLWG RGTLVTVSSGGGGS GGGGSGGGGSGGAI QLTQSPSSLSASVG DRVTITCRASQGIS SALAWYQQKPGKAP KLLIYDASSLESGV PSRFSGSGSGTDFT LTISSLQPEDFATY YCQQFNNYPLTFGG GTKVEIK (SEQ ID NO: 205) | GAAGTGCAGCTGCTGGAAAGCGGCGGAGGCCTGGTGCAGCCT GGCGGCAGCCTGAGACTGTCTTGCGCCGCCAGCGGCTTCACC TTCAGCAGCTACGCCATGAGCTGGGTCCGCCAGGCCCCTGGC AAGGGACTCGAATGGGTGTCCGCCATCAGCGGCAGCGGCGGC AGCACCTACTACGCCGACAGCGTGAAGGGCCGGTTCACCATC AGCCGGGACAACAGCAAGAACACCCTGTACCTGCAGATGAAC AGCCTGCGGGCCGAGGACACCGCCGTATATTACTGTGCGACA TGGATGGGGGGCGGGGACGATGGTACTTCGATCTCTGGGGC CGTGGCACCCTGGTCACTGTGTCCTCAGGCGGAGGTGGAAGC GGGGGAGGTGGCGGAGGATCTGGCGGCGGAGGAAGCGGAGGCGCCATC CAGCTGACCCAGAGCCCCAGCAGCCTGAGCGCCAGCGTGGGC GACAGAGTGACCATCACCTGTCGGGCCAGCCAGGGCATCAGC AGCGCTCTGGCCTGGTATCAGCAGAAGCCCGGCAAGGCCCCC AAGCTGCTGATCTACGACGCGTCCTCCCTGGAAAGCGGCGTG CCCAGCAGATTCAGCGGCAGCGGCTCCGGCACCGACTTCACC CTGACCATCAGCAGCCTGCAGCCCGAGGACTTCGCCACCTAC TACTGCCAGCAGTTTAATAATTACCCTCTCACTTTCGGCGGC GGAACAAAGGTGGAGATCAAG (SEQ ID NO: 418) |
| 53 EVQLLESGGGLVQP GGSLRLSCAASGFT FSSYAMSWVRQAPG KGLEWVSAISGSGG STYYADSVKGRFTI SRDNSKNTLYLQMN SLRAEDTAVYYCAR TSRTTWYFDLWGRG TLVTVSSGGGGSGG GGSGGGGSGGAIQL TQSPSSLSASVGDR VTITCRASQGISSA LAWYQQKPGKAPKL LIYDASSLESGVPS RFSGSGSGTDFTLT ISSLQPEDFATYYC QQFNNYPLTFGGGT KVEIK (SEQ ID NO: 206) | GAAGTGCAGCTGCTGGAAAGCGGCGGAGGCCTGGTGCAGCCT GGCGGCAGCCTGAGACTGTCTTGCGCCGCCAGCGGCTTCACC TTCAGCAGCTACGCCATGAGCTGGGTCCGCCAGGCCCCTGGC AAGGGACTCGAATGGGTGTCCGCCATCAGCGGCAGCGGCGGC AGCACCTACTACGCCGACAGCGTGAAGGGCCGGTTCACCATC AGCCGGGACAACAGCAAGAACACCCTGTACCTGCAGATGAAC AGCCTGCGGGCCGAGGACACCGCCGTATATTACTGTGCGAGA ACTAGTCGTACAACCTGGTACTTCGATCTCTGGGGCCGTGGC ACCCTGGTCACTGTGTCCTCAGGCGGAGGTGGAAGCGGAGGG GGATCTGGCGGCGGAGGAAGCGGAGGCGCCATCCAGCTG ACCCAGAGCCCCAGCAGCCTGAGCGCCAGCGTGGGCGACAGA GTGACCATCACCTGTCGGGCCAGCCAGGGCATCAGCAGCGCT CTGGCCTGGTATCAGCAGAAGCCCGGCAAGGCCCCCAAGCTG CTGATCTACGACGCGTCCTCCCTGGAAAGCGGCGTGCCCAGC AGATTCAGCGGCAGCGGCTCCGGCACCGACTTCACCCTGACC ATCAGCAGCCTGCAGCCCGAGGACTTCGCCACCTACTACTGC CAGCAGTTTAATAATTACCCTCTCACTTTCGGCGGCGGAACA AAGGTGGAGATCAAG (SEQ ID NO: 419) |
| 54 EVQLLESGGGLVQP GGSLRLSCAASGFT FSSYAMSWVRQAPG KGLEWVSAISGSGG STYYADSVKGRFTI SRDNSKNTLYLQMN SLRAEDTAVYYCAK WMGGGGRLYFDLWG RGTLVTVSSGGGGS | GAAGTGCAGCTGCTGGAAAGCGGCGGAGGCCTGGTGCAGCCT GGCGGCAGCCTGAGACTGTCTTGCGCCGCCAGCGGCTTCACC TTCAGCAGCTACGCCATGAGCTGGGTCCGCCAGGCCCCTGGC AAGGGACTCGAATGGGTGTCCGCCATCAGCGGCAGCGGCGGC AGCACCTACTACGCCGACAGCGTGAAGGGCCGGTTCACCATC AGCCGGGACAACAGCAAGAACACCCTGTACCTGCAGATGAAC AGCCTGCGGGCCGAGGACACCGCCGTATATTACTGTGCGAAA TGGATGGGGGGCGGGGGACGATTATACTTCGATCTCTGGGGC CGTGGCACCCTGGTCACTGTGTCCTCAGGCGGAGGTGGAAGC |

TABLE 1-continued

Exemplary MSLN scFv domains

| | Protein Sequence | DNA Sequence |
|---|---|---|
| | GGGGSGGGGSGGAI QLTQSPSSLSASVG DRVTITCRASQGIS SALAWYQQKPGKAP KLLIYDASSLESGV PSRFSGSGSGTDFT LTISSLQPEDFATY YCQQFNNYPLTFGG GTKVEIK (SEQ ID NO: 207) | GGAGGGGGAGGATCTGGCGGCGGAGGAAGCGGAGGCGCCATC CAGCTGACCCAGAGCCCCAGCAGCCTGAGCGCCAGCGTGGGC GACAGAGTGACCATCACCTGTCGGGCCAGCCAGGGCATCAGC AGCGCTCTGGCCTGGTATCAGCAGAAGCCCGGCAAGGCCCCC AAGCTGCTGATCTACGACGCGTCCTCCCTGGAAAGCGGCGTG CCCAGCAGATTCAGCGGCAGCGGCTCCGGCACCGACTTCACC CTGACCATCAGCAGCCTGCAGCCCGAGGACTTCGCCACCTAC TACTGCCAGCAGTTTAATAATTACCCTCTCACTTTCGGCGGC GGAACAAAGGTGGAGATCAAG (SEQ ID NO: 420) |
| 55 | EVQLLESGGGLVQP GGSLRLSCAASGFT FSSYAMSWVRQAPG KGLEWVSAISGSGG STYYADSVKGRFTI SRDNSKNTLYLQMN SLRAEDTAVYYCAK WGGRLYWYFDLWGR GTLVTVSSGGGGSG GGGSGGGGSGGAIQ LTQSPSSLSASVGD RVTITCRASQGISS ALAWYQQKPGKAPK LLIYDASSLESGVP SRFSGSGSGTDFTL TISSLQPEDFATYY CQQFNNYPLTFGGG TKVEIK (SEQ ID NO: 208) | GAAGTGCAGCTGCTGGAAAGCGGCGGAGGCCTGGTGCAGCCT GGCGGCAGCCTGAGACTGTCTTGCGCCGCCAGCGGCTTCACC TTCAGCAGCTACGCCATGAGCTGGGTCCGCCAGGCCCCTGGC AAGGGACTCGAATGGGTGTCCGCCATCAGCGGCAGCGGCGGC AGCACCTACTACGCCGACAGCGTGAAGGGCCGGTTCACCATC AGCCGGGACAACAGCAAGAACACCCTGTACCTGCAGATGAAC AGCCTGCGGGCCGAGGACACCGCCGTATATTACTGTGCGAAA TGGGGGGGCGGTTGTACTGGTACTTCGATCTCTGGGCCGT GGCACCCTGGTCACTGTGTCCTCAGGCGGAGGTGGAAGCGGA GGGGGAGGATCTGGCGGCGGAGGAAGCGGAGGCGCCATCCAG CTGACCCAGAGCCCCAGCAGCCTGAGCGCCAGCGTGGGCGAC AGAGTGACCATCACCTGTCGGGCCAGCCAGGGCATCAGCAGC GCTCTGGCCTGGTATCAGCAGAAGCCCGGCAAGGCCCCCAAG CTGCTGATCTACGACGCGTCCTCCCTGGAAAGCGGCGTGCCC AGCAGATTCAGCGGCAGCGGCTCCGGCACCGACTTCACCCTG ACCATCAGCAGCCTGCAGCCCGAGGACTTCGCCACCTACTAC TGCCAGCAGTTTAATAATTACCCTCTCACTTTCGGCGGCGGA ACAAAGGTGGAGATCAAG (SEQ ID NO: 421) |
| 56 | EVQLLESGGGLVQP GGSLRLSCAASGFT FSSYAMSWVRQAPG KGLEWVSAISGSGG STYYADSVKGRFTI SRDNSKNTLYLQMN SLRAEDTAVYYCAK VIRQLWYFDLWGRG TLVTVSSGGGGSGG GGSGGGGSGGAIQL TQSPSSLSASVGDR VTITCRASQGISSA LAWYQQKPGKAPKL LIYDASSLESGVPS RFSGSGSGTDFTLT ISSLQPEDFATYYC QQFNNYPLTFGGGT KVEIK (SEQ ID NO: 209) | GAAGTGCAGCTGCTGGAAAGCGGCGGAGGCCTGGTGCAGCCT GGCGGCAGCCTGAGACTGTCTTGCGCCGCCAGCGGCTTCACC TTCAGCAGCTACGCCATGAGCTGGGTCCGCCAGGCCCCTGGC AAGGGACTCGAATGGGTGTCCGCCATCAGCGGCAGCGGCGGC AGCACCTACTACGCCGACAGCGTGAAGGGCCGGTTCACCATC AGCCGGGACAACAGCAAGAACACCCTGTACCTGCAGATGAAC AGCCTGCGGGCCGAGGACACCGCCGTATATTACTGTGCGAAA GTTATTCGGCAACTCTGGTACTTCGATCTCTGGGCCGTGGCC ACCCTGGTCACTGTGTCCTCAGGCGGAGGTGGAAGCGGAGGG GGAGGATCTGGCGGCGGAGGAAGCGGAGGCGCCATCCAGCTG ACCCAGAGCCCCAGCAGCCTGAGCGCCAGCGTGGGCGACAGA GTGACCATCACCTGTCGGGCCAGCCAGGGCATCAGCAGCGCT CTGGCCTGGTATCAGCAGAAGCCCGGCAAGGCCCCCAAGCTG CTGATCTACGACGCGTCCTCCCTGGAAAGCGGCGTGCCCAGC AGATTCAGCGGCAGCGGCTCCGGCACCGACTTCACCCTGACC ATCAGCAGCCTGCAGCCCGAGGACTTCGCCACCTACTACTGC CAGCAGTTTAATAATTACCCTCTCALTTTCGGCGGCGGAACA AAGGTGGAGATCAAG (SEQ ID NO: 422) |
| 57 | EVQLLESGGGLVQP GGSLRLSCAASGFT FSSYAMSWVRQAPG KGLEWVSAISGSGG STYYADSVKGRFTI SRDNSKNTLYLQMN SLRAEDTAVYYCAK VFANSWYFDLWGRG TLVTVSSGGGGSGG GGSGGGGSGGAIQL TQSPSSLSASVGDR VTITCRASQGISSA LAWYQQKPGKAPKL LIYDASSLESGVPS RFSGSGSGTDFTLT ISSLQPEDFATYYC QQFNNYPLTFGGGT KVEIK (SEQ ID NO: 210) | GAAGTGCAGCTGCTGGAAAGCGGCGGAGGCCTGGTGCAGCCT GGCGGCAGCCTGAGACTGTCTTGCGCCGCCAGCGGCTTCACC TTCAGCAGCTACGCCATGAGCTGGGTCCGCCAGGCCCCTGGC AAGGGACTCGAATGGGTGTCCGCCATCAGCGGCAGCGGCGGC AGCACCTACTACGCCGACAGCGTGAAGGGCCGGTTCACCATC AGCCGGGACAACAGCAAGAACACCCTGTACCTGCAGATGAAC AGCCTGCGGGCCGAGGACACCGCCGTATATTACTGTGCGAAA GTTTTCGCCAACTCCTGGTACTTCGATCTCTGGGCCGTGGCC ACCCTGGTCACTGTGTCCTCAGGCGGAGGTGGAAGCGGAGGG GGAGGATCTGGCGGCGGAGGAAGCGGAGGCGCCATCCAGCTG ACCCAGAGCCCCAGCAGCCTGAGCGCCAGCGTGGGCGACAGA GTGACCATCACCTGTCGGGCCAGCCAGGGCATCAGCAGCGCT CTGGCCTGGTATCAGCAGAAGCCCGGCAAGGCCCCCAAGCTG CTGATCTACGACGCGTCCTCCCTGGAAAGCGGCGTGCCCAGC AGATTCAGCGGCAGCGGCTCCGGCACCGACTTCACCCTGACC ATCAGCAGCCTGCAGCCCGAGGACTTCGCCACCTACTACTGC CAGCAGTTTAATAATTACCCTCTCACTTTCGGCGGCGGAACA AAGGTGGAGATCAAG (SEQ ID NO: 423) |
| 58 | EVQLLESGGGLVQP GGSLRLSCAASGFT FSSYAMSWVRQAPG KGLEWVSAISGSGG | GAAGTGCAGCTGCTGGAAAGCGGCGGAGGCCTGGTGCAGCCT GGCGGCAGCCTGAGACTGTCTTGCGCCGCCAGCGGCTTCACC TTCAGCAGCTACGCCATGAGCTGGGTCCGCCAGGCCCCTGGC AAGGGACTCGAATGGGTGTCCGCCATCAGCGGCAGCGGCGGC |

TABLE 1-continued

Exemplary MSLN scFv domains

| | Protein Sequence | DNA Sequence |
|---|---|---|
| | STYYADSVKGRFTI SRDNSKNTLYLQMN SLRAEDTAVYYCAK VDRTTWYFDLWGRG TLVTVSSGGGGSGG GGSGGGGSGGAIQL TQSPSSLSASVGDR VTITCRASQGISSA LAWYQQKPGKAPKL LIYDASSLESGVPS RFSGSGSGTDFTLT ISSLQPEDFATYYC QQFNNYPLTFGGGT KVEIK (SEQ ID NO: 211) | AGCACCTACTACGCCGACAGCGTGAAGGGCCGGTTCACCATC AGCCGGGACAACAGCAAGAACACCCTGTACCTGCAGATGAAC AGCCTGCGGGCCGAGGACACCGCCGTATATTACTGTGCGAAA GTAGATAGGACTACCTGGTACTTCGATCTCTGGGGCCGTGGC ACCCTGGTCACTGTGTCCTCAGGCGGAGGTGGAAGCGGAGGG GGAGGATCTGGCGGCGGAGGAAGCGGAGGCGCCATCCAGCTG ACCCAGAGCCCCAGCAGCCTGAGCGCCAGCGTGGGCGACAGA GTGACCATCACCTGTCGGGCCAGCCAGGGCATCAGCAGCGCT CTGGCCTGGTATCAGCAGAAGCCCGGCAAGGCCCCCAAGCTG CTGATCTACGACGCGTCCTCCCTGGAAAGCGGCGTGCCCAGC AGATTCAGCGGCAGCGGCTCCGGCACCGACTTCACCCTGACC ATCAGCAGCCTGCAGCCCGAGGACTTCGCCACCTACTACTGC CAGCAGTTTAATAATTACCCTCTCACTTTCGGCGGCGGAACA AAGGTGGAGATCAAG (SEQ ID NO: 424) |
| 59 | EVQLLESGGGLVQP GGSLRLSCAASGFT FSSYAMSWVRQAPG KGLEWVSAISGSGG STYYADSVKGRFTI SRDNSKNTLYLQMN SLRAEDTAVYYCAK RWGKDGPYWYFDLW GRGTLVTVSSGGGG SGGGGSGGGGSGGA IQLTQSPSSLSASV GDRVTITCRASQGI SSALAWYQQKPGKA PKLLIYDASSLESG VPSRFSGSGSGTDF TLTISSLQPEDFAT YYCQQFNNYPLTFG GGTKVEIK (SEQ ID NO: 212) | GAAGTGCAGCTGCTGGAAAGCGGCGGAGGCCTGGTGCAGCCT GGCGGCAGCCTGAGACTGTCTTGCGCCGCCAGCGGCTTCACC TTCAGCAGCTACGCCATGAGCTGGGTCCGCCAGGCCCCTGGC AAGGGACTCGAATGGGTGTCCGCCATCAGCGGCAGCGGCGGC AGCACCTACTACGCCGACAGCGTGAAGGGCCGGTTCACCATC AGCCGGGACAACAGCAAGAACACCCTGTACCTGCAGATGAAC AGCCTGCGGGCCGAGGACACCGCCGTATATTACTGTGCGAAA CGATGGGGTAAGGATGGTCCTTACTGGTACTTCGATCTCTGG GGCCGTGGCACCCTGGTCACTGTGTCCTCAGGCGGAGGTGGA AGCGGAGGGGGAGGATCTGGCGGCGGAGGAAGCGGAGGCGCC ATCCAGCTGACCCAGAGCCCCAGCAGCCTGAGCGCCAGCGTG GGCGACAGAGTGACCATCACCTGTCGGGCCAGCCAGGGCATC AGCAGCGCTCTGGCCTGGTATCAGCAGAAGCCCGGCAAGGCC CCCAAGCTGCTGATCTACGACGCGTCCTCCCTGGAAAGCGGC GTGCCCAGCAGATTCAGCGGCAGCGGCTCCGGCACCGACTTC ACCCTGACCATCAGCAGCCTGCAGCCCGAGGACTTCGCCACC TACTACTGCCAGCAGTTTAATAATTACCCTCTCACTTTCGGC GGCGGAACAAAGGTGGAGATCAAG (SEQ ID NO: 425) |
| 60 | EVQLLESGGGLVQP GGSLRLSCAASGFT FSSYAMSWVRQAPG KGLEWVSAISGSGG STYYADSVKGRFTI SRDNSKNTLYLQMN SLRAEDTAVYYCAK RRDSYGPYWYFDLW GRGTLVTVSSGGGG SGGGGSGGGGSGGA IQLTQSPSSLSASV GDRVTITCRASQGI SSALAWYQQKPGKA PKLLIYDASSLESG VPSRFSGSGSGTDF TLTISSLQPEDFAT YYCQQFNNYPLTFG GGTKVEIK (SEQ ID NO: 213) | GAAGTGCAGCTGCTGGAAAGCGGCGGAGGCCTGGTGCAGCCT GGCGGCAGCCTGAGACTGTCTTGCGCCGCCAGCGGCTTCACC TTCAGCAGCTACGCCATGAGCTGGGTCCGCCAGGCCCCTGGC AAGGGACTCGAATGGGTGTCCGCCATCAGCGGCAGCGGCGGC AGCACCTACTACGCCGACAGCGTGAAGGGCCGGTTCACCATC AGCCGGGACAACAGCAAGAACACCCTGTACCTGCAGATGAAC AGCCTGCGGGCCGAGGACACCGCCGTATATTACTGTGCGAAA AGAAGAGACAGTTATGGTCCTTACTGGTACTTCGATCTCTGG GGCCGTGGCACCCTGGTCACTGTGTCCTCAGGCGGAGGTGGA AGCGGAGGGGGAGGATCTGGCGGCGGAGGAAGCGGAGGCGCC ATCCAGCTGACCCAGAGCCCCAGCAGCCTGAGCGCCAGCGTG GGCGACAGAGTGACCATCACCTGTCGGGCCAGCCAGGGCATC AGCAGCGCTCTGGCCTGGTATCAGCAGAAGCCCGGCAAGGCC CCCAAGCTGCTGATCTACGACGCGTCCTCCCTGGAAAGCGGC GTGCCCAGCAGATTCAGCGGCAGCGGCTCCGGCACCGACTTC ACCCTGACCATCAGCAGCCTGCAGCCCGAGGACTTCGCCACC TACTACTGCCAGCAGTTTAATAATTACCCTCTCACTTTCGGC GGCGGAACAAAGGTGGAGATCAAG (SEQ ID NO: 426) |
| 61 | EVQLLESGGGLVQP GGSLRLSCAASGFT FSSYAMSWVRQAPG KGLEWVSAISGSGG STYYADSVKGRFTI SRDNSKNTLYLQMN SLRAEDTAVYYCAK NRPPPGYWYFDLWG RGTLVTVSSGGGGS GGGGSGGGGSGGAI QLTQSPSSLSASVG DRVTITCRASQGIS SALAWYQQKPGKAP KLLIYDASSLESGV | GAAGTGCAGCTGCTGGAAAGCGGCGGAGGCCTGGTGCAGCCT GGCGGCAGCCTGAGACTGTCTTGCGCCGCCAGCGGCTTCACC TTCAGCAGCTACGCCATGAGCTGGGTCCGCCAGGCCCCTGGC AAGGGACTCGAATGGGTGTCCGCCATCAGCGGCAGCGGCGGC AGCACCTACTACGCCGACAGCGTGAAGGGCCGGTTCACCATC AGCCGGGACAACAGCAAGAACACCCTGTACCTGCAGATGAAC AGCCTGCGGGCCGAGGACACCGCCGTATATTACTGTGCGAAG AATCGTCCCCCGCCGGGTACTGGTACTTCGATCTCTGGGGC CGTGGCACCCTGGTCACTGTGTCCTCAGGCGGAGGTGGAAGC GGAGGGGGAGGATCTGGCGGCGGAGGAAGCGGAGGCGCCATC CAGCTGACCCAGAGCCCCAGCAGCCTGAGCGCCAGCGTGGGC GACAGAGTGACCATCACCTGTCGGGCCAGCCAGGGCATCAGC AGCGCTCTGGCCTGGTATCAGCAGAAGCCCGGCAAGGCCCCC AAGCTGCTGATCTACGACGCGTCCTCCCTGGAAAGCGGCGTG |

TABLE 1-continued

Exemplary MSLN scFv domains

| | Protein Sequence | DNA Sequence |
|---|---|---|
| | PSRFSGSGSGTDFT LTISSLQPEDFATY YCQQFNNYPLTFGG GTKVEIK (SEQ ID NO: 214) | CCCAGCAGATTCAGCGGCAGCGGCTCCGGCACCGACTTCACC CTGACCATCAGCAGCCTGCAGCCCGAGGACTTCGCCACCTAC TACTGCCAGCAGTTTAATAATTACCCTCTCACTTTCGGCGGC GGAACAAAGGTGGAGATCAAG (SEQ ID NO: 427) |
| 62 | EVQLLESGGGLVQP GGSLRLSCAASGFT FSSYAMSWVRQAPG KGLEWVSAISGSGG STYYADSVKGRFTI SRDNSKNTLYLQMN SLRAEDTAVYYCAK GRRFSWYFDLWGRG TLVTVSSGGGGSGG GGSGGGGSGGAIQL TQSPSSLSASVGDR VTITCRASQGISSA LAWYQQKPGKAPKL LIYDASSLESGVPS RFSGSGSGTDFTLT ISSLQPEDFATYYC QQFNNYPLTFGGGT KVEIK (SEQ ID NO: 215) | GAAGTGCAGCTGCTGGAAAGCGGCGGAGGCCTGGTGCAGCCT GGCGGCAGCCTGAGACTGTCTTGCGCCGCCAGCGGCTTCACC TTCAGCAGCTACGCCATGAGCTGGGTCCGCCAGGCCCCTGGC AAGGGACTCGAATGGGTGTCCGCCATCAGCGGCAGCGGCGGC AGCACCTACTACGCCGACAGCGTGAAGGGCCGGTTCACCATC AGCCGGGACAACAGCAAGAACACCCTGTACCTGCAGATGAAC AGCCTGCGGGCCGAGGACACCGCCGTATATTACTGTGCGAAG GGAAGACGATTTAGCTGGTACTTCGATCTCTGGGGCCGTGGC ACCCTGGTCACTGTGTCCTCAGGCGGAGGTGGAAGCGGAGGG GGAGGATCTGGCGGCGGAGGAAGCGGAGGCGCCATCCAGCTG ACCCAGAGCCCCAGCAGCCTGAGCGCCAGCGTGGGCGACAGA GTGACCATCACCTGTCGGGCCAGCCAGGGCATCAGCAGCGCT CTGGCCTGGTATCAGCAGAAGCCCGGCAAGGCCCCCAAGCTG CTGATCTACGACGCTCCTCCCTGGAAAGCGGCGTGCCCAGC AGATTCAGCGGCAGCGGCTCCGGCACCGACTTCACCCTGACC ATCAGCAGCCTGCAGCCCGAGGACTTCGCCACCTACTACTGC CAGCAGTTTAATAATTACCCTCTCACTTTCGGCGGCGGAACA AAGGTGGAGATCAAG (SEQ ID NO: 428) |

In some embodiments, the extracellular ligand binding domain of the first receptor is an scFv. In some embodiments, the scFv domain binds to MSLN. In some embodiments, the scFv is the ligand binding domain of a CAR. Exemplary scFv domains specific to MSLN are shown in Table 1, supra. In Table 1, underlining indicates CDR sequences.

In some embodiments, the extracellular ligand binding domain of the first receptor comprises an antigen binding domain having at least 80% identity, at least 85% identity, at least 90% identity, at least 95% identity, at least 97% identity or at least 99% identity to a sequence of SEQ ID NOS: 3-6, 80 or 154-215, or a sequence as set forth in Table 1. In some embodiments, the extracellular ligand binding domain of the first receptor comprises an antigen binding domain comprising a sequence of SEQ ID NOS: 3-6, 80 or 154-215, as set forth in Table 1.

In some embodiments, the extracellular ligand binding domain of the first receptor comprises an binding domain having at least 80% identity, at least 85% identity, at least 90% identity, at least 95% identity, at least 97% identity or at least 99% identity to a sequence of SEQ ID NO: 171. In some embodiments, the extracellular ligand binding domain of the first receptor comprises an binding domain comprising a sequence of SEQ ID NO: 171.

In some embodiments, the extracellular ligand binding domain of the first receptor comprises an scFv antigen binding domain having at least 80% identity, at least 85% identity, at least 90% identity, at least 95% identity, at least 97% identity or at least 99% identity to any one of SEQ ID NOs: 3-6. In some embodiments, the extracellular ligand binding domain of the first receptor comprises an scFv antigen binding domain comprising a sequence of any one of SEQ ID NOs: 3-6 or 80. In some embodiments, the extracellular ligand binding domain of the first receptor consists essentially of a sequence selected from the group consisting of SEO ID NOs: 3-6 or 80.

TABLE 2

Sequences of MSLN complementary determining regions (CDRs)

| # | HC CDR1 | HC CDR2 | HC CDR3 | LC |
|---|---|---|---|---|
| 1 | NAWMS (SEQ ID NO: 429) | RIKSKTDGGTTDYAAP VKG (SEQ ID NO: 450) | DLPKLRNFHI (SEQ ID NO: 471) | A |
| 2 | SYAMH (SEQ ID NO: 430) | AISSNGGSTYYANSVK G (SEQ ID NO: 451) | LEYHGFRQYGLRYWH (SEQ ID NO: 472) | A |
| 3 | SGGYSWS (SEQ ID NO: 431) | YIYHSGSTYYNPSLKS (SEQ ID NO: 452) | IKFWFAGINYFFP (SEQ ID NO: 473) | A |
| 4 | SYWMH (SEQ ID NO: 449) | RINSDGSSTSYADSVKG (SEQ ID NO: 453) | GFLGMGSNFI (SEQ ID NO: 474) | A |

TABLE 2-continued

Sequences of MSLN complementary determining regions (CDRs)

| | | | | |
|---|---|---|---|---|
| 5 | SGGYYWS (SEQ ID NO: 432) | YIYYSGSTYYNPSLKS (SEQ ID NO: 454) | GDRARYFDL (SEQ ID NO: 475) | A |
| 6 | SYWMH (SEQ ID NO: 449) | RINSDGSSTSYADSVKG (SEQ ID NO: 453) | YPRGYHQMVDAFDI (SEQ ID NO: 476) | A |
| 7 | SSSYYWG (SEQ ID NO: 433) | SIYYSGSTYYNPSLKS (SEQ ID NO: 455) | VRFLAARTTIPEANFL (SEQ ID NO: 477) | A |
| 8 | SYSMN (SEQ ID NO: 434) | YISSSSSTIYYADSVKG (SEQ ID NO: 456) | VLSRARFDY (SEQ ID NO: 478) | A |
| 9 | SYSMN (SEQ ID NO: 434) | SISSSSSYIYYADSVKG (SEQ ID NO: 457) | LRGRVFDP (SEQ ID NO: 479) | A |
| 10 | SSSYYWG (SEQ ID NO: 433) | SIYYSGSTYYNPSLKS (SEQ ID NO: 455) | IKFTSFLYVHGFL (SEQ ID NO: 480) | A |
| 11 | SYAMH (SEQ ID NO: 430) | WINAGNGNTKYSQKFQG (SEQ ID NO: 458) | GQRWLYLGGIRRH (SEQ ID NO: 481) | A |
| 12 | SYYWS (SEQ ID NO: 435) | YIYYSGSTNYNPSLKS (SEQ ID NO: 459) | EWIPSRPYYFDY (SEQ ID NO: 482) | A |
| 13 | SGGYYWS (SEQ ID NO: 432) | YIYYSGSTYYNPSLKS (SEQ ID NO: 454) | ESTGTGAFDI (SEQ ID NO: 483) | A |
| 14 | DYGMS (SEQ ID NO: 436) | GINWNGGSTGYADSVKG (SEQ ID NO: 460) | ERYRRVLHWYFDL (SEQ ID NO: 484) | A |
| 15 | SYDIN (SEQ ID NO: 437) | WMNPNSGNTGYAQKFQG (SEQ ID NO: 461) | EPDAFDI (SEQ ID NO: 485) | A |
| 16 | SGGYYWS (SEQ ID NO: 432) | YIYYSGSTYYNPSLKS (SEQ ID NO: 454) | EHMGTIPYYFDY (SEQ ID NO: 486) | A |
| 17 | SGGYYWS (SEQ ID NO: 432) | YIYYSGSTYYNPSLKS (SEQ ID NO: 454) | EEFGYGDVLY (SEQ ID NO: 487) | A |
| 18 | SGDYYWS (SEQ ID NO: 438) | YIYYSGSTYYNPSLKS (SEQ ID NO: 454) | EDWKGAFDI (SEQ ID NO: 488) | A |
| 19 | SYSMN (SEQ ID NO: 434) | YISSSSSTIYYADSVKG (SEQ ID NO: 456) | EDFSHKLGYFQH (SEQ ID NO: 489) | A |
| 20 | DYYMS (SEQ ID NO: 439) | YISSSGSTIYYADSVKG (SEQ ID NO: 462) | DYDYV (SEQ ID NO: 490) | A |
| 21 | SGDYYWS (SEQ ID NO: 438) | YIYYSGSTYYNPSLKS (SEQ ID NO: 454) | DRRDWDWFDP (SEQ ID NO: 491) | A |
| 22 | SSNWWS (SEQ ID NO: 440) | EIYHSGSTNYNPSLKS (SEQ ID NO: 463) | DQQALKYRVD (SEQ ID NO: 492) | A |

TABLE 2-continued

Sequences of MSLN complementary determining regions (CDRs)

| | | | | |
|---|---|---|---|---|
| 23 | SYGIS (SEQ ID NO: 441) | WISAYNGNTNYAQKLQG (SEQ ID NO: 464) | DLTLGCFDY (SEQ ID NO: 493) | A |
| 24 | SNYMS (SEQ ID NO: 442) | VIYSGGSTYYADSVKG (SEQ ID NO: 465) | DGSNSWYFDL (SEQ ID NO: 494) | A |
| 25 | SYGMH (SEQ ID NO: 443) | VIWYDGSNKYYADSVKG (SEQ ID NO: 466) | AFLFLSFSV (SEQ ID NO: 495) | A |
| 26 | DYTMH (SEQ ID NO: 444) | LISWDGGSTYYADSVKG (SEQ ID NO: 467) | GIFYSSKEDFDY (SEQ ID NO: 496) | A |
| 27 | DYTMH (SEQ ID NO: 444) | LISWDGGSTYYADSVKG (SEQ ID NO: 467) | DIWIFYSSNPKPTVY (SEQ ID NO: 497) | A |
| 28 | SYAMN (SEQ ID NO: 445) | WINTNTGNPTYAQGFTG (SEQ ID NO: 468) | KDQTLTYGNWFDP (SEQ ID NO: 498) | A |
| 29 | SGSYYWS (SEQ ID NO: 446) | YIYYSGSTNYNPSLKS (SEQ ID NO: 459) | DHYERGLY (SEQ ID NO: 499) | A |
| 30 | DYYMS (SEQ ID NO: 439) | YISSSGSTIYYADSVKG (SEQ ID NO: 462) | YMYNWYFDL (SEQ ID NO: 500) | B |
| 31 | DYYMS (SEQ ID NO: 439) | YISSSGSTIYYADSVKG (SEQ ID NO: 462) | DRRPAFDI (SEQ ID NO: 501) | B |
| 32 | DYYMS (SEQ ID NO: 439) | YISSSGSTIYYADSVKG (SEQ ID NO: 462) | HLKRRPYFDY (SEQ ID NO: 502) | C |
| 33 | DYYMS (SEQ ID NO: 439) | YISSSGSTIYYADSVKG (SEQ ID NO: 462) | VHKKPIFDY (SEQ ID NO: 503) | C |
| 34 | DYYMS (SEQ ID NO: 439) | YISSSGSTIYYADSVKG (SEQ ID NO: 462) | TSRRCTFQH (SEQ ID NO: 504) | C |
| 35 | DYYMS (SEQ ID NO: 439) | YISSSGSTIYYADSVKG (SEQ ID NO: 462) | TSPRPLFQH (SEQ ID NO: 505) | C |
| 36 | DYYMS (SEQ ID NO: 439) | YISSSGSTIYYADSVKG (SEQ ID NO: 462) | PYQVRGVYFDY (SEQ ID NO: 506) | C |
| 37 | DYYMS (SEQ ID NO: 439) | YISSSGSTIYYADSVKG (SEQ ID NO: 462) | PYKKRRTVFDY (SEQ ID NO: 507) | C |
| 38 | DYYMS (SEQ ID NO: 439) | YISSSGSTIYYADSVKG (SEQ ID NO: 462) | LQRGLALFQH (SEQ ID NO: 508) | C |
| 39 | DYYMS (SEQ ID NO: 439) | YISSSGSTIYYADSVKG (SEQ ID NO: 462) | ILSVPYFDL (SEQ ID NO: 509) | C |
| 40 | DYYMS (SEQ ID NO: 439) | YISSSGSTIYYADSVKG (SEQ ID NO: 462) | GWIRVPLRLPLFQH (SEQ ID NO: 510) | C |
| 41 | DYYMS (SEQ ID NO: 439) | YISSSGSTIYYADSVKG (SEQ ID NO: 462) | VTIFAIFDI (SEQ ID NO: 511) | C |

TABLE 2-continued

Sequences of MSLN complementary determining regions (CDRs)

| | | | | |
|---|---|---|---|---|
| 42 | DYYMS (SEQ ID NO: 439) | YISSSGSTIYYADSVKG (SEQ ID NO: 462) | VGRGFVHFDL (SEQ ID NO: 512) | C |
| 43 | DYYMS (SEQ ID NO: 439) | YISSSGSTIYYADSVKG (SEQ ID NO: 462) | TSRGLCVLFDY (SEQ ID NO: 513) | C |
| 44 | DYYMS (SEQ ID NO: 439) | YISSSGSTIYYADSVKG (SEQ ID NO: 462) | SGPSSYWYFDL (SEQ ID NO: 514) | C |
| 45 | DYYMS (SEQ ID NO: 439) | YISSSGSTIYYADSVKG (SEQ ID NO: 462) | NIYMGGIWFDP (SEQ ID NO: 515) | C |
| 46 | DYYMS (SEQ ID NO: 439) | YISSSGSTIYYADSVKG (SEQ ID NO: 462) | LTVRTGAFDI (SEQ ID NO: 516) | C |
| 47 | DYYMS (SEQ ID NO: 439) | YISSSGSTIYYADSVKG (SEQ ID NO: 462) | LRTAHLDFDL (SEQ ID NO: 517) | C |
| 48 | DYYMS (SEQ ID NO: 439) | YISSSGSTIYYADSVKG (SEQ ID NO: 462) | DLIFPWFDY (SEQ ID NO: 518) | C |
| 49 | DYYMS (SEQ ID NO: 439) | YISSSGSTIYYADSVKG (SEQ ID NO: 462) | DGYRKYGYVFFDI (SEQ ID NO: 519) | C |
| 50 | DYYMS (SEQ ID NO: 439) | YISSSGSTIYYADSVKG (SEQ ID NO: 462) | DGRYRRFWHAFDI (SEQ ID NO: 520) | C |
| 51 | DYYMS (SEQ ID NO: 439) | YISSSGSTIYYADSVKG (SEQ ID NO: 462) | AHIRGYFDL (SEQ ID NO: 521) | C |
| 52 | SYAMS (SEQ ID NO: 447) | AISGSGGSTYYADSVKG (SEQ ID NO: 469) | WMGGGGRWYFDL (SEQ ID NO: 522) | C |
| 53 | SYAMS (SEQ ID NO: 447) | AISGSGGSTYYADSVKG (SEQ ID NO: 469) | TSRTTWYFDL (SEQ ID NO: 523) | C |
| 54 | SYAMS (SEQ ID NO: 447) | AISGSGGSTYYADSVKG (SEQ ID NO: 469) | WMGGGGRLYFDL (SEQ ID NO: 524) | C |
| 55 | SYAMS (SEQ ID NO: 447) | AISGSGGSTYYADSVKG (SEQ ID NO: 469) | WGGRLYWYFDL (SEQ ID NO: 525) | C |
| 56 | SYAMS (SEQ ID NO: 447) | AISGSGGSTYYADSVKG (SEQ ID NO: 469) | VIRQLWYFDL (SEQ ID NO: 526) | C |
| 57 | SYAMS (SEQ ID NO: 447) | AISGSGGSTYYADSVKG (SEQ ID NO: 469) | VFANSWYFDL (SEQ ID NO: 527) | C |
| 58 | SYAMS (SEQ ID NO: 447) | AISGSGGSTYYADSVKG (SEQ ID NO: 469) | VDRTTWYFDL (SEQ ID NO: 528) | C |
| 59 | SYAMS (SEQ ID NO: 447) | AISGSGGSTYYADSVKG (SEQ ID NO: 469) | RWGKDGPYWYFDL (SEQ ID NO: 529) | C |
| 60 | SYAMS (SEQ ID NO: 447) | AISGSGGSTYYADSVKG (SEQ ID NO: 469) | RRDSYGPYWYFDL (SEQ ID NO: 530) | C |

TABLE 2-continued

Sequences of MSLN complementary determining regions (CDRs)

| 61 | SYAMS (SEQ ID NO: 447) | AISGSGGSTYYADSVKG (SEQ ID NO: 469) | NRPPPGYWYFDL (SEQ ID NO: 531) | C |
|---|---|---|---|---|
| 62 | SYAMS (SEQ ID NO: 447) | AISGSGGSTYYADSVKG (SEQ ID NO: 469) | GRRFSWYFDL (SEQ ID NO: 532) | C |
|  | SGDYYWS (SEQ ID NO: 438) | YIYYSGSTYYNPSLKS (SEQ ID NO: 454) | CAREDVVKGAFDIW (SEQ ID NO: 533) | A |
|  | GYTMN (SEQ ID NO: 448) | LITPYNGAS SYNQKFRG (SEQ ID NO: 470) | GGYDGRGFDY (SEQ ID NO: 534) | D |

Light chain CDRs

|  | LC CDR1 | LC CDR2 | LC CDR3 |
|---|---|---|---|
| A | RASQSISS YLN (SEQ ID NO: 535) | AASSLQS (SEQ ID NO: 539) | QQSYSTPLT (SEQ ID NO: 542) |
| B | RASQGISS WLA (SEQ ID NO: 536) | AASSLQS (SEQ ID NO: 539) | QQANSFPLT (SEQ ID NO: 543) |
| C | RASQGISS ALA (SEQ ID NO: 537) | DASSLES (SEQ ID NO: 540) | QQFNSYPLT (SEQ ID NO: 544) |
| D | SASSSVSY MH (SEQ ID NO: 538) | DTSKLAS (SEQ ID NO: 541) | QQWSGYPLT (SEQ ID NO: 545) |

In Table 2, the light chain (LC) CDRs paired with the indicated heavy chain (HC) CDRs are indicated in the left column.

In some embodiments, the extracellular ligand binding domain of the first receptor comprises the HC CDR1, the HC CDR2, and the HC CDR3 set forth in Table 2 (e.g., the HC CDR 1, the HC CDR2, and the HC CDR 3 of line #1, line #2, line #3, etc. of Table 2) or sequences having at most 1, 2, or 3 substitutions, deletions, or insertion relative to the CDRs of Table 2. In some embodiments, the extracellular ligand binding domain of the first receptor comprises the LC CDR1, the LC CDR2, and the LC CDR3 set forth in Table 2 (e.g., the LC CDR 1, the LC CDR2, and the LC CDR 3 of line A, line B, or line C of Table 2) or sequences having at most 1, 2, or 3 substitutions, deletions, or insertion relative to the CDRs of Table 2. In some embodiments, the extracellular ligand binding domain of the first receptor comprises the HC CDR1, the HC CDR2, and the HC CDR3 set forth in Table 2 (e.g., the HC CDR 1, the HC CDR2, and the HC CDR 3 of line #1, line #2, line #3, etc. of Table 2). In some embodiments, the extracellular ligand binding domain of the first receptor comprises the LC CDR1, the LC CDR2, and the LC CDR3 set forth in Table 2 (e.g., the LC CDR 1, the LC CDR2, and the LC CDR 3 of line A, line B, or line C of Table 2).

In some embodiments, the extracellular ligand binding domain of the first receptor comprises the HC CDR1, HC CDR2, HC CDR3, LC CDR1, the LC CDR2, and the LC CDR3 set forth in Table 2 (e.g., the HC CDR1, HC CDR2 and HC CDR3 set forth in line 1, and the LC CDR 1, the LC CDR2, and the LC CDR 3 in line A) In some embodiments, the extracellular ligand binding domain of the first receptor comprises the HC CDR1, the HC CDR2, and the HC CDR3 set forth in Table 2 (e.g., the HC CDR 1, the HC CDR2, and the HC CDR 3 of line #1, line #2, line #3, etc. of Table 2) or sequences having at most 1, 2, or 3 substitutions, deletions, or insertion relative to the CDRs of Table 2. In some embodiments, the extracellular ligand binding domain of the first receptor comprises the LC CDR1, the LC CDR2, and the LC CDR3 set forth in Table 2 (e.g., the LC CDR 1, the LC CDR2, and the LC CDR 3 of line A, line B, or line C of Table 2) or sequences having at most 1, 2, or 3 substitutions, deletions, or insertion relative to the CDRs of Table 2. In some embodiments, an extracellular ligand binding domain of the first receptor comprises one or more HC CDRs set forth in Table 2 and one or more LC CDRs set forth in Table 2. In some embodiments, the extracellular ligand binding domain of the first receptor comprises (i) the HC CDR1, the HC CDR2, and the HC CDR3 set forth in one line of Table 2 (e.g., the HC CDR 1, the HC CDR2, and the HC CDR 3 of line #1, line #2, line #3, etc. of Table 2) and (ii) the LC CDR1, the LC CDR2, and the LC CDR3 set forth in one line of Table 2 (e.g., the LC CDR 1, the LC CDR2, and the LC CDR 3 of line A, line B, or line C of Table 2). In each case, the HC CDRs may be paired with any of the LC CDRs, as the heavy chains and light chains share similarity, with routine testing to confirm desired expression and binding activity; however, preferred pairing between heavy and light chains of some embodiments are indicated in the right hand column of Table 2.

In some embodiments, the extracellular ligand binding domain of the first receptor comprises a HC CDR1 comprising a sequence of SGDYYWS (SEQ ID NO: 438), a HC CDR2 comprising a sequence of YIYYSGSTYYNPSLKS (SEQ ID NO: 454), and HC CDR3 comprising a sequence of CAREDVVKGAFDIW (SEQ ID NO: 533), or CDR sequences having at most 1, 2 or 3 amino acid substitutions, insertions or deletions relative thereto. In some embodiments, the extracellular ligand binding domain of the first receptor comprises a HC CDR1 comprising a sequence of SGDYYWS (SEQ ID NO: 438), a HC CDR2 comprising a sequence of YIYYSGSTYYNPSLKS (SEQ ID NO: 454), and HC CDR3 comprising a sequence of CAREDVVKGAFDIW (SEQ ID NO: 533). In some embodiments, the extracellular ligand binding domain of the first receptor comprises a LC CDR1 comprising a sequence of RASQSISSYLN (SEQ ID NO: 535), a LC CDR2 comprising a sequence of AASSLQS (SEQ ID NO: 539), and a LC CDR3 comprising a sequence of QQSYSTPLT (SEQ ID NO: 542), or CDR sequences having at most 1, 2 or 3 amino acid substitutions, insertions or deletions relative thereto. In some embodiments, the extracellular ligand binding domain of the first receptor comprises a LC CDR1 comprising a sequence of RASQSISSYLN (SEQ ID NO: 535), a LC CDR2 comprising a sequence of AASSLQS (SEQ ID NO: 539), and a LC CDR3 comprising a sequence of QQSYSTPLT (SEQ ID NO: 542). In some embodiments, the extracellular ligand binding domain of the first receptor comprises a HC CDR1 comprising a sequence of SGDYYWS (SEQ ID NO: 438), a HC CDR2 comprising a sequence of YIYYSGSTYYNPSLKS (SEQ ID NO: 454), HC CDR3 comprising a sequence of CAREDVVKGAFDIW (SEQ ID NO: 533), a LC CDR1 comprising a sequence of RASQSISSYLN (SEQ ID NO: 535), a LC CDR2 comprising a sequence of AASSLQS (SEQ ID NO: 539), and a LC CDR3 comprising a sequence of QQSYSTPLT (SEQ ID NO: 542), or CDR sequences having at most 1, 2 or 3 amino acid substitutions, insertions or deletions relative thereto. In some embodiments, the extracellular ligand binding domain of the first receptor comprises a HC CDR1 comprising a sequence of SGDYYWS (SEQ ID NO: 438), a HC CDR2 comprising a sequence of YIYYSGSTYYNPSLKS (SEQ ID NO: 454), HC CDR3 comprising a sequence of CAREDVVKGAFDIW (SEQ ID NO: 533), a LC CDR1 comprising a sequence of RASQSISSYLN (SEQ ID NO: 535), a LC CDR2 comprising a sequence of AASSLQS (SEQ ID NO: 539), and a LC CDR3 comprising a sequence of QQSYSTPLT (SEQ ID NO: 542).

In some embodiments, the extracellular ligand binding domain of the first receptor comprises an scFv. In some embodiments, the scFv comprises a heavy chain comprising CDRs selected from the sequences of GYTMN (SEQ ID NO: 448), LITPYNGASSYNQKFRG (SEQ ID NO: 470) and GGYDGRGFDY (SEQ ID NO: 534). In some embodiments, the heavy chain comprises sequences of GYTMN (SEQ ID NO: 448), LITPYNGASSYNQKFRG (SEQ ID NO: 470) and GGYDGRGFDY (SEQ ID NO: 534). In some embodiments, the scFv comprising a light chain comprising CDRs selected from the sequences of SASSSVSYMH (SEQ ID NO: 538), DTSKLAS (SEQ ID NO: 541) and QQWSGYPLT (SEQ ID NO: 545). In some embodiments, the light chain comprises sequences of SASSSVSYMH (SEQ ID NO: 538), DTSKLAS (SEQ ID NO: 541) and QQWSGYPLT (SEQ ID NO: 545).

Sequences of exemplary heavy and light chains of antigen binding domains that are specific to MSLN are set forth in Tables 3 and 4 below. Light chains paired with heavy chains in preferred embodiments are indicated at right in Table 3.

TABLE 2

Sequences of heavy chain variable fragments (VH)

| # | SEQ ID NO | Heavy Chain (VH) | LC |
|---|---|---|---|
| 1 | 216 | EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDLPKLRNFHIWGQGTLVTVSS | A |
| 2 | 217 | EVQLVESGGGLVQPGGSLRLSCAASGFTFSSYAMHWVRQAPGKGLEYVSAISSNGGSTYYANSVKGRFTISRDNSKNTLYLQMGSLRAEDMAVYYCASLEYHGFRQYGLRYWHWGQGTLVTVSS | A |
| 3 | 218 | QLQLQESGSGLVKPSQTLSLTCAVSGGSISSGGYSWSWIRQPPGKGLEWIGYIYHSGSTYYNPSLKSRVTISVDRSKNQFSLKLSSVTAADTAVYYCASIKFWFAGINYFFPWGQGTLVTVSS | A |
| 4 | 219 | EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCASGFLGMGSNFIWGQGTLVTVSS | A |
| 5 | 220 | QVQLQESGPGLVKPSQTLSLTCTVSGGSISSGGYYWSWIRQHPGKGLEWIGYIYYSGSTYYNPSLKSLVTISVDTSKNQFSLKLSSVTAADTAVYYCASGDRARYFDLWGRGTLVTVSS | A |
| 6 | 221 | EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARYPRGYHQMVDAFDIWGQGTMVTVSS | A |
| 7 | 222 | QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARVRFLAARTTIPEANFLWGQGTLVTVSS | A |

TABLE 2-continued

Sequences of heavy chain variable fragments (VH)

| # | SEQ ID NO | Heavy Chain (VH) | LC |
|---|---|---|---|
| 8 | 223 | EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARVLSRARFDYWGQGTLVTVSS | A |
| 9 | 224 | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARLRGRVFDPWGQGTLVTVSS | A |
| 10 | 225 | QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARIKFTSFLYVHGFLWGQGTLVTVSS | A |
| 11 | 226 | QVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARGQRWLYLGGIRRHWGQGTLVTVSS | A |
| 12 | 227 | QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAREWIPSRPYYFDYWGQGTLVTVSS | A |
| 13 | 228 | QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARESTGTGAFDIWGQGTMVTVSS | A |
| 14 | 229 | EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCARERYRRVLHWYFDLWGRGTLVTVSS | A |
| 15 | 230 | QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCAREPDAFDIWGQGTMVTVSS | A |
| 16 | 231 | QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREHMGTIPYYFDYWGQGTLVTVSS | A |
| 17 | 232 | QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREEFGYGDVLYWGQGTLVTVSS | A |
| 18 | 233 | QVQLQESGPGLVKPSQTLSLTCTVSGGSISSGDYYWSWIRQPPGKGLEWIGYIYYSGSTYYNPSLKSRVTISVDTSKNQFSLKLSSVTAADTAVYYCAREDVVKGAFDIWGQGTMVTVSS | A |
| 19 | 234 | EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCAREDFSHKLGYFQHWGQGTLVTVSS | A |
| 20 | 235 | QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDYDYVWGQGTLVTVSS | A |
| 21 | 236 | QVQLQESGPGLVKPSQTLSLTCTVSGGSISSGDYYWSWIRQPPGKGLEWIGYIYYSGSTYYNPSLKSRVTISVDTSKNQFSLKLSSVTAADTAVYYCARDRRDWDWFDPWGQGTLVTVSS | A |
| 22 | 237 | QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARDQQALKYRVDWGQGTLVTVSS | A |
| 23 | 238 | QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDLTLGCFDYWGQGTLVTVSS | A |
| 24 | 239 | EVQLVESGGGLVQPGGSLRLSCAASGFTVSSNYMSWVRQAPGKGLEWVSVIYSGGSTYYADSVKGRFTISRDNSKNTLYLQMNSLRAEDTAVYYCARDGSNSWYFDLWGRGTLVTVSS | A |
| 25 | 240 | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARAFLFLSFSVWGQGTLVTVSS | A |

TABLE 2-continued

Sequences of heavy chain variable fragments (VH)

| # | SEQ ID NO | Heavy Chain (VH) | LC |
|---|---|---|---|
| 26 | 241 | EVQLVESGGVVVQPGGSLRLSCAASGFTFDDYTMHWVRQA PGKGLEWVSLISWDGGSTYYADSVKGRFTISRDNSKNSLYL QMNSLRTEDTALYYCAKGIFYSSKEDFDYWGQGTLVTVSS | A |
| 27 | 242 | EVQLVESGGVVVQPGGSLRLSCAASGFTFDDYTMHWVRQA PGKGLEWVSLISWDGGSTYYADSVKGRFTISRDNSKNSLYL QMNSLRTEDTALYYCAKDIWIFYSSNPKPTVYWGQGTLVTV SS | A |
| 28 | 243 | QVQLVQSGSELKKPGASVKVSCKASGYTFTSYAMNWVRQA PGQGLEWMGWINTNTGNPTYAQGFTGRFVFSFDTSVSTAYL QICSLKAEDTAVYYCARKDQTLTYGNWFDPWGQGTLVTVS S | A |
| 29 | 244 | QVQLQESGPGLVKPSETLSLTCTVSGGSVSSGSYYWSWIRQP PGKGLEWIGYIYYSGSTNYNPSLKSRVTISVDTSKNQFSLKLS SVTAADTAVYYCARDHYERGLYWGQGTLVTVSS | A |
| 30 | 245 | QVQLVESGGGLVKPGGSLRLSCAASGFTFSDYYMSWIRQAP GKGLEWVSYISSSGSTIYYADSVKGRFTISRDNAKNSLYLQM NSLRAEDTAVYYCARYMYNWYFDLWGRGTLVTVSS | B |
| 31 | 246 | QVQLVESGGGLVKPGGSLRLSCAASGFTFSDYYMSWIRQAP GKGLEWVSYISSSGSTIYYADSVKGRFTISRDNAKNSLYLQM NSLRAEDTAVYYCARDRRPAFDIWGQGTMVTVSS | B |
| 32 | 247 | QVQLVESGGGLVKPGGSLRLSCAASGFTFSDYYMSWIRQAP GKGLEWVSYISSSGSTIYYADSVKGRFTISRDNAKNSLYLQM NSLRAEDTAVYYCAVHLKRRPYFDYWGQGTLVTVSS | C |
| 33 | 248 | QVQLVESGGGLVKPGGSLRLSCAASGFTFSDYYMSWIRQAP GKGLEWVSYISSSGSTIYYADSVKGRFTISRDNAKNSLYLQM NSLRAEDTAVYYCASVHKKPIFDYWGQGTLVTVSS | C |
| 34 | 249 | QVQLVESGGGLVKPGGSLRLSCAASGFTFSDYYMSWIRQAP GKGLEWVSYISSSGSTIYYADSVKGRFTISRDNAKNSLYLQM NSLRAEDTAVYYCASTSRRCTFQHWGQGTLVTVSS | C |
| 35 | 250 | QVQLVESGGGLVKPGGSLRLSCAASGFTFSDYYMSWIRQAP GKGLEWVSYISSSGSTIYYADSVKGRFTISRDNAKNSLYLQM NSLRAEDTAVYYCASTSPRPLFQHWGQGTLVTVSS | C |
| 36 | 251 | QVQLVESGGGLVKPGGSLRLSCAASGFTFSDYYMSWIRQAP GKGLEWVSYISSSGSTIYYADSVKGRFTISRDNAKNSLYLQM NSLRAEDTAVYYCASPYQVRGVYFDYWGQGTLVTVSS | C |
| 37 | 252 | QVQLVESGGGLVKPGGSLRLSCAASGFTFSDYYMSWIRQAP GKGLEWVSYISSSGSTIYYADSVKGRFTISRDNAKNSLYLQM NSLRAEDTAVYYCASPYKKRRTVFDYWGQGTLVTVSS | C |
| 38 | 253 | QVQLVESGGGLVKPGGSLRLSCAASGFTFSDYYMSWIRQAP GKGLEWVSYISSSGSTIYYADSVKGRFTISRDNAKNSLYLQM NSLRAEDTAVYYCASLQRGLALFQHWGQGTLVTVSS | C |
| 39 | 254 | QVQLVESGGGLVKPGGSLRLSCAASGFTFSDYYMSWIRQAP GKGLEWVSYISSSGSTIYYADSVKGRFTISRDNAKNSLYLQM NSLRAEDTAVYYCASILSVPYFDLWGRGTLVTVSS | C |
| 40 | 255 | QVQLVESGGGLVKPGGSLRLSCAASGFTFSDYYMSWIRQAP GKGLEWVSYISSSGSTIYYADSVKGRFTISRDNAKNSLYLQM NSLRAEDTAVYYCASGWIRVPLRLPLFQHWGQGTLVTVSS | C |
| 41 | 256 | QVQLVESGGGLVKPGGSLRLSCAASGFTFSDYYMSWIRQAP GKGLEWVSYISSSGSTIYYADSVKGRFTISRDNAKNSLYLQM NSLRAEDTAVYYCARVTIFAIFDIWGQGTMVTVSS | C |
| 42 | 257 | QVQLVESGGGLVKPGGSLRLSCAASGFTFSDYYMSWIRQAP GKGLEWVSYISSSGSTIYYADSVKGRFTISRDNAKNSLYLQM NSLRAEDTAVYYCARVGRGFVHFDLWGRGTLVTVSS | C |
| 43 | 259 | QVQLVESGGGLVKPGGSLRLSCAASGFTFSDYYMSWIRQAP GKGLEWVSYISSSGSTIYYADSVKGRFTISRDNAKNSLYLQM NSLRAEDTAVYYCARTSRGLCVLFDYWGQGTLVTVSS | C |

TABLE 2-continued

Sequences of heavy chain variable fragments (VH)

| # | SEQ ID NO | Heavy Chain (VH) | LC |
|---|---|---|---|
| 44 | 260 | QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARSGPSSYWYFDLWGRGTLVTVSS | C |
| 45 | 261 | QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARNIYMGGIWFDPWGQGTLVTVSS | C |
| 46 | 262 | QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARLTVRTGAFDIWGQGTMVTVSS | C |
| 47 | 263 | QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARLRTAHLDFDLWGRGTLVTVSS | C |
| 48 | 264 | QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLIFPVVFDYWGQGTLVTVSS | C |
| 49 | 265 | QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDGYRKYGYVFFDIWGQGTMVTVSS | C |
| 50 | 266 | QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDGRYRRFWHAFDIWGQGTMVTVSS | c |
| 51 | 267 | QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARAHIRGYFDLWGRGTLVTVSS | c |
| 52 | 268 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCATWMGGGRWYFDLWGRGTLVTVSS | c |
| 53 | 269 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARTSRTTWYFDLWGRGTLVTVSS | c |
| 54 | 270 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKWMGGGRLYFDLWGRGTLVTVSS | c |
| 55 | 271 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKWGGRLYWYFDLWGRGTLVTVSS | c |
| 56 | 272 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVIRQLWYFDLWGRGTLVTVSS | c |
| 57 | 273 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVFANSWYFDLWGRGTLVTVSS | c |
| 58 | 274 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVDRTTWYFDLWGRGTLVTVSS | c |
| 59 | 275 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKRWGKDGPYWYFDLWGRGTLVTVSS | c |
| 60 | 276 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKRRDSYGPYWYFDLWGRGTLVTVSS | c |
| 61 | 277 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKNRPPPGYWYFDLWGRGTLVTVSS | c |

TABLE 2-continued

Sequences of heavy chain variable fragments (VH)

| # | SEQ ID NO | Heavy Chain (VH) | LC |
|---|---|---|---|
| 62 | 278 | EVQLLESGGGLVQPGGSLRLSCAASGFTFSSYAMSWVRQAP GKGLEWVSAISGSGGSTYYADSVKGRFTISRDNSKNTLYLQ MNSLRAEDTAVYYCAKGRRFSWYFDLWGRGTLVTVSS | C |

TABLE 3

Sequences of light chain variable fragments (VL)

| # | SEQ ID NO | Light Chain (VL) |
|---|---|---|
| A | 279 | DIQMTQSPSSLSASVGDRVTITCRASQSISSYLNWYQQKPGKAPKLLI YAASSLQSGVPSRFSGSGSGTDFTLTISSLQPEDFATYYCQQSYSTPLT FGGGTKVEIK |
| B | 280 | DIQMTQSPSSVSASVGDRVTITCRASQGISSWLAWYQQKPGKAPKLLI YAASSLQSGVPSRFSGSGSGTDFTLTISSLQPEDFATYYCQQANSFPLT FGGGTKVEIK |
| C | 281 | AIQLTQSPSSLSASVGDRVTITCRASQGISSALAWYQQKPGKAPKLLI YDASSLESGVPSRFSGSGSGTDFTLTISSLQPEDFATYYCQQFNSYPLT FGGGTKVEIK |
| D | 282 | AIQLTQSPSSLSASVGDRVTITCRASQGISSALAWYQQKPGKAPKLLI YDASSLESGVPSRFSGSGSGTDFTLTISSLQPEDFATYYCQQFNNYPLT FGGGTKVEIK |

In some embodiments, the extracellular ligand binding domain of the first receptor comprises a variable heavy region (VH) sequence set forth in Table 3. In some embodiments, the extracellular ligand binding domain of the first receptor comprises a VH sequence that has at least 80%, at least 85%, at least 90%, at least 91%, at least 92%, at least 93%, at least 94%, at least 95%, at least 96%, at least 97%, at least 98%, or at least 99% sequence identity to a VH set forth in Table 3. In some embodiments, the extracellular ligand binding domain of the first receptor comprises a variable light region (VL) sequence set forth in Table 4. In some embodiments, the extracellular ligand binding domain of the first receptor comprises a VL sequence that has at least 80%, at least 85%, at least 90%, at least 91%, at least 92%, at least 93%, at least 94%, at least 95%, at least 96%, at least 97%, at least 98%, or at least 99% sequence identity to a VL set forth set forth in Table 4.

In some embodiments, a the extracellular ligand binding domain of the first receptor comprises a VH that (i) comprises the HC CDR1, the HC CDR2, and the HC CDR3 sequences set forth in Table 2 (e.g., the HC CDR 1, the HC CDR2, and the HC CDR 3 of line #1, line #2, line #3, etc. of Table 2) and (ii) has at least 80%, at least 85%, at least 90%, at least 91%, at least 92%, at least 93%, at least 94%, at least 95%, at least 96%, at least 97%, at least 98%, or at least 99% sequence identity to a VH sequence set forth in Table 3. In some embodiments, extracellular ligand binding domain of the first receptor (i) comprises the LC CDR1, the LC CDR2, and the LC CDR3 sequences set forth in one line Table 2 (e.g., the LC CDR 1, the LC CDR2, and the LC CDR 3 of line A, line B, or line C of Table 2) and a VL sequence set forth in Table 4 and (ii) has at least 80%, at least 85%, at least 90%, at least 91%, at least 92%, at least 93%, at least 94%, at least 95%, at least 96%, at least 97%, at least 98%, or at least 99% sequence identity to a VL set forth set forth in Table 4.

In some embodiments, the extracellular ligand binding domain of the first receptor comprises (i) a VH sequence set forth in Table 3 or a VH sequence that has at least 80%, at least 85%, at least 90%, at least 91%, at least 92%, at least 93%, at least 94%, at least 95%, at least 96%, at least 97%, at least 98%, or at least 99% sequence identity to a VH set forth in Table 3, and (ii) a VL sequence set forth in Table 4 or a VL that has at least 80%, at least 85%, at least 90%, at least 91%, at least 92%, at least 93%, at least 94%, at least 95%, at least 96%, at least 97%, at least 98%, or at least 99% sequence identity to a VL set forth set forth in Table 4. In each case, the VH may be paired with any of the VLs, as the heavy chains and light chains share similarity, with routine testing to confirm desired expression and binding activity; however, the preferred pairing between Table 3 and Table 4 is indicated in the "LC" column of Table 3, corresponding to the # column of Table 4.

In some embodiments, the extracellular ligand binding domain of the first receptor comprises a VH sequence of SEQ ID NO: 233, or a sequence that has at least 80%, at least 85%, at least 90%, at least 91%, at least 92%, at least 93%, at least 94%, at least 95%, at least 96%, at least 97%, at least 98%, or at least 99% sequence identity thereto. In some embodiments, the extracellular ligand binding domain of the first receptor comprises a VH sequence of SEQ ID NO: 233.

In some embodiments, the extracellular ligand binding domain of the first receptor comprises a VL sequence of SEQ ID NO: 279, or a sequence that has at least 80%, at least 85%, at least 90%, at least 91%, at least 92%, at least 93%, at least 94%, at least 95%, at least 96%, at least 97%, at least 98%, or at least 99% sequence identity thereto. In some embodiments, the extracellular ligand binding domain of the first receptor comprises a VL sequence of SEQ ID NO: 279. In some embodiments, the extracellular ligand binding domain of the first receptor comprises a VH sequence of SEQ ID NO: 233, and a VL sequence of SEQ ID NO: 279, or sequences that have at least 80%, at least 85%, at least 90%, at least 91%, at least 92%, at least 93%, at least 94%, at least 95%, at least 96%, at least 97%, at least 98%, or at least 99% sequence identity thereto. In some embodiments the VH and VL are separated for a linker, for example a linker comprising a sequence of GGGGSGGGGSGGGGSGG (SEQ ID NO: 152). The VH and VL can be in any orientation, for example VH, linker, VL; or alternatively, VL, linker VH.

In some embodiments, one or more (e.g., 1, 2, 3, 4, 5, or 6) amino acid residues in a CDR of the antigen binding domains provided herein are substituted with another amino acid. The substitution may be "conservative" in the sense of being a substitution within the same family of amino acids. The naturally occurring amino acids may be divided into the following four families and conservative substitutions will take place within those families: (1) amino acids with basic side chains: lysine, arginine, histidine; (2) amino acids with acidic side chains: aspartic acid, glutamic acid; (3) amino acids with uncharged polar side chains: asparagine, glutamine, serine, threonine, tyrosine; and (4) amino acids with nonpolar side chains: glycine, alanine, valine, leucine, isoleucine, proline, phenylalanine, methionine, tryptophan, cysteine. By varying the amino acid sequence of the CDRs of an antibody by addition, deletion or substitution of amino acids, various effects such as increased binding affinity for the target antigen may be obtained.

Chimeric Antigen Receptors (CARs)

The disclosure provides a first, activator receptor and immune cells comprising same. In some embodiments, the first receptor is a chimeric antigen receptor.

The term "chimeric antigen receptors (CARs)" as used herein, may refer to artificial receptors derived from T-cell receptors and encompasses engineered receptors that graft an artificial specificity onto a particular immune effector cell. CARs may be employed to impart the specificity of a monoclonal antibody onto a T cell, thereby allowing a large number of specific T cells to be generated, for example, for use in adoptive cell therapy. In specific embodiments, CARs direct specificity of the cell to a tumor associated antigen, for example. Exemplary CARs comprise an intracellular activation domain, a transmembrane domain, and an extracellular domain comprising a tumor associated antigen binding region. In some embodiments, CARs further comprise a hinge domain. In particular aspects, CARs comprise fusions of single-chain variable fragments (scFv) derived from monoclonal antibodies, fused to a CD3 transmembrane domain and endodomain. The specificity of other CAR designs may be derived from ligands of receptors (e.g., peptides). In certain cases, CARs comprise domains for additional co-stimulatory signaling, such as CD3, 4-1BB, FcR, CD27, CD28, CD137, DAP10, and/or OX40. In some cases, molecules can be co-expressed with the CAR, including co-stimulatory molecules, reporter genes for imaging, gene products that conditionally ablate the T cells upon addition of a pro-drug, homing receptors, cytokines, and cytokine receptors.

In some embodiments, the extracellular ligand binding domain of the first receptor is fused to the extracellular domain of a CAR.

In some embodiments, the CARs of the present disclosure comprise an extracellular hinge region. Incorporation of a hinge region can affect cytokine production from CAR-T cells and improve expansion of CAR-T cells in vivo. Exemplary hinges can be isolated or derived from IgD and CD8 domains, for example IgG1. In some embodiments, the hinge is isolated or derived from CD8a or CD28.

In some embodiments, the hinge is isolated or derived from CD8a or CD28. In some embodiments, the CD8α hinge comprises an amino acid sequence having at least 80% identity, at least 90% identity, at least 95% identity, at least 99% identity or is identical to a sequence of TTTPAPRPPT-PAPTIASQPLSLRPEACRPAAGGAVHTRGLDFACD (SEQ ID NO: 7). In some embodiments, the CD8α hinge comprises SEQ ID NO: 7. In some embodiments, the CD8α hinge consists essentially of SEQ ID NO: 7. In some embodiments, the CD8α hinge is encoded by a nucleotide sequence having at least 80% identity, at least 90% identity, at least 95% identity, at least 99% identity or is identical to a sequence of ACCACGACGCCAGCGCCGCGACCAC-CAACACCGGCGCCCAC-CATCGCGTCGCAGCCCCTGTCCCTGCGCCCAGAG GCGTGCCGGCCAGCGGCGGGGGGCGCAGTGCACA CGAGGGGGCTGGACTTCGCCTGTGAT (SEQ ID NO: 8). In some embodiments, the CD8α hinge is encoded by SEQ ID NO: 8.

In some embodiments, the CD28 hinge comprises an amino acid sequence having at least 80% identity, at least 90% identity, at least 95% identity, at least 99% identity or is identical to a sequence of CTIEVMYPPPYLD-NEKSNGTIIHVKGKHLCPSPLFPGPSKP (SEQ ID NO: 9). In some embodiments, the CD28 hinge comprises or consists essentially of SEQ ID NO: 9. In some embodiments, the CD28 hinge is encoded by a nucleotide sequence having at least 80% identity, at least 90% identity, at least 95% identity, at least 99% identity or is identical to a sequence of TGTACCATTGAAGT-TATGTATCCTCCTCCTTACCTAGACAAT-GAGAAGAGCAATGGAACCAT TATCCATGT-GAAAGGGAAACACCTTTGTCCAAGTCCCCTATTTC CCGGACCTTCTAAGCCC (SEQ ID NO: 10). In some embodiments, the CD28 hinge is encoded by SEQ ID NO: 10.

The CARs of the present disclosure can be designed to comprise a transmembrane domain that is fused to the extracellular domain of the CAR. In some embodiments, the transmembrane domain that naturally is associated with one of the domains in the CAR is used. For example, a CAR comprising a CD28 co-stimulatory domain might also use a CD28 transmembrane domain. In some instances, the transmembrane domain can be selected or modified by amino acid substitution to avoid binding of such domains to the transmembrane domains of the same or different surface membrane proteins to minimize interactions with other members of the receptor complex.

The transmembrane domain may be derived either from a natural or from a synthetic source. Where the source is natural, the domain may be derived from any membrane-bound or transmembrane protein. Transmembrane regions may be isolated or derived from (i.e. comprise at least the transmembrane region(s) of) the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137, CD154, or from an immunoglobulin such as IgG4. Alternatively the transmembrane domain may be synthetic, in which case it will comprise predominantly hydrophobic residues such as leucine and valine. In some embodiments, a triplet of phenylalanine, tryptophan and valine will be found at each end of a synthetic transmembrane domain. Optionally, a short oligo- or polypeptide linker, preferably between 2 and 10 amino acids in length may form the linkage between the transmembrane domain and the cytoplasmic signaling domain of the CAR. A glycine-serine doublet provides a particularly suitable linker.

In some embodiments of the CARs of the disclosure, the CARs comprise a CD28 transmembrane domain. In some embodiments, the CD28 transmembrane domain comprises an amino acid sequence having at least 80% identity, at least 90% identity, at least 95% identity, at least 99% identity or is identical to a sequence of FWVLVVVGGVLACYSLLVTVAFIIFWV (SEQ ID NO: 11). In some embodiments, the CD28 transmembrane domain comprises or consists essentially of SEQ ID NO: 11. In some embodiments, the CD28 transmembrane domain is encoded by a nucleotide sequence having at least 80% identity, at least 90% identity, at least 95% identity, at least 99% identity or is identical to a sequence of TTCTGGGTGCTGGTCGTTGTGGGCGGCGTGCTGGCCTGCTACAGCCTGCTGGTGACAGTGGCCTTCATCATCTTT TGGGTG (SEQ ID NO: 12). In some embodiments, the CD28 transmembrane domain is encoded by SEQ ID NO: 12.

In some embodiments of the CARs of the disclosure, the CARs comprise an IL-2Rbeta transmembrane domain. In some embodiments, the IL-2Rbeta transmembrane domain comprises an amino acid sequence having at least 80% identity, at least 90% identity, at least 95% identity, at least 99% identity or is identical to a sequence of IPWLGHLLVGLSGAFGFIILVYLLI (SEQ ID NO: 13). In some embodiments, the IL-2Rbeta transmembrane domain comprises or consists essentially of SEQ ID NO: 13. In some embodiments, the IL-2Rbeta transmembrane domain is encoded by a nucleotide sequence having at least 80% identity, at least 90% identity, at least 95% identity, at least 99% identity or is identical to a sequence of ATTCCGTGGCTCGGCCACCT CCTCGTGGGC CTCAGCGGGG CTTTTGGCTT CATCATCTTA GTGTACTTGC TGATC (SEQ ID NO: 14). In some embodiments, the IL-2Rbeta transmembrane domain is encoded by SEQ ID NO: 14.

The cytoplasmic domain or otherwise the intracellular signaling domain of the CARs of the instant disclosure is responsible for activation of at least one of the normal effector functions of the immune cell in which the CAR has been placed. The term "effector function" refers to a specialized function of a cell. Thus the term "intracellular signaling domain" refers to the portion of a protein which transduces the effector function signal and directs the cell to perform a specialized function. While usually the entire intracellular signaling domain can be employed, in many cases it is not necessary to use the entire domain. To the extent that a truncated portion of the intracellular signaling domain is used, such truncated portion may be used in place of the intact chain as long as it transduces the effector function signal. In some cases, multiple intracellular domains can be combined to achieve the desired functions of the CAR-T cells of the instant disclosure. The term intracellular signaling domain is thus meant to include any truncated portion of one or more intracellular signaling domains sufficient to transduce the effector function signal.

Examples of intracellular signaling domains for use in the CARs of the instant disclosure include the cytoplasmic sequences of the T cell receptor (TCR) and co-receptors that act in concert to initiate signal transduction following antigen receptor engagement, as well as any derivative or variant of these sequences and any synthetic sequence that has the same functional capability.

Accordingly, the intracellular domain of CARs of the instant disclosure comprises at least one cytoplasmic activation domain. In some embodiments, the intracellular activation domain ensures that there is T-cell receptor (TCR) signaling necessary to activate the effector functions of the CAR T-cell. In some embodiments, the at least one cytoplasmic activation is a CD247 molecule (CD3ζ) activation domain, a stimulatory killer immunoglobulin-like receptor (KIR) KIR2DS2 activation domain, or a DNAX-activating protein of 12 kDa (DAP12) activation domain.

In some embodiments, the CD3ζ activation domain comprises an amino acid sequence having at least 80% identity, at least 90% identity, at least 95% identity, at least 99% identity or is identical to a sequence of RVKFSRSADAPAYKQGQNQLYNELNLGRREEYDVLDKRRGRDPEMGGKPRRKNPQ EGLYNELQKDKMAEAYSEIGMKGERRRGKGHDGLYQGLSTATKDTYDALHMQAL PPR (SEQ ID NO: 15).

In some embodiments, the CD3ζ activation domain comprises or consists essentially of SEQ ID NO: 15. In some embodiments, the CD3ζ activation domain is encoded by a nucleotide sequence having at least 80% identity, at least 90% identity, at least 95% identity, at least 99% identity or is identical to a sequence of AGAGTGAAGTTCAGCAGGAGCGCAGACGCCCCCGCGTACAAGCAGGGCCAGAACCAGCTCTATAACGAGCTCAAT CTAGGACGAAGAGAGGAGTACGATGTTTTGGACAAGCGTAGAGGCCGGGACCCTGAGATGGGGGGAAAGCCGAGA AGGAAGAACCCTCAGGAAGGCCTGTACAATGAACTGCAGAAAGATAAGATGGCGGAGGCCTACAGTGAGATTGGG ATGAAAGGCGAGCGCCGGAGGGGCAAGGGGCACGATGGCCTTTACCAGGGACTCAGTACAGCCACCAAGGACACC TACGACGCCCTTCACATGCAGGCCCTGCCCCCTCGC (SEQ ID NO: 16). In some embodiments, the CD3ζ activation domain is encoded by SEQ ID NO: 16).

It is known that signals generated through the TCR alone are often insufficient for full activation of the T cell and that a secondary or co-stimulatory signal is also required. Thus, T cell activation can be said to be mediated by two distinct classes of cytoplasmic signaling sequence: those that initiate antigen-dependent primary activation through the TCR (primary cytoplasmic signaling sequences) and those that act in an antigen-independent manner to provide a secondary or co-stimulatory signal (secondary cytoplasmic signaling sequences).

Primary cytoplasmic signaling sequences regulate primary activation of the TCR complex either in a stimulatory way, or in an inhibitory way. Primary cytoplasmic signaling sequences that act in a stimulatory manner may contain signaling motifs, which are known as immunoreceptor tyrosine-based activation motifs or ITAMs. In some embodiments, the ITAM contains a tyrosine separated from a leucine or an isoleucine by any two other amino acids (YxxL/I (SEQ ID NO: 546)). In some embodiments, the cytoplasmic domain contains 1, 2, 3, 4 or 5 ITAMs. An exemplary ITAM containing cytoplasmic domain is the CD3 activation domain. Further examples of ITAM containing primary cytoplasmic signaling sequences that can be used in the CARs of the instant disclosure include those derived from TCRζ, FcRγ, FcRβ, CD3γ, CD3δ, CD3ε, CD3ζ, CD5, CD22, CD79a, CD79b, and CD66d.

In some embodiments, the CD3ζ activation domain comprising a single ITAM comprises an amino acid sequence having at least 80% identity, at least 90% identity, at least 95% identity, at least 99% identity or is identical to a sequence of RVKFSRSADAPAYQQGQNQLYNELNLGR-REEYDVLHMQALPPR (SEQ ID NO: 17). In some embodiments, the CD3ζ activation domain comprises SEQ ID NO: 17. In some embodiments, the CD3ζ activation domain comprising a single ITAM consists essentially of an amino acid sequence of RVKFSRSADAPAYQQGQNQLY-NELNLGRREEYDVLHMQALPPR (SEQ ID NO: 17). In some embodiments, the CD3ζ activation domain comprising a single ITAM is encoded by a nucleotide sequence having at least 80% identity, at least 90% identity, at least 95% identity, at least 99% identity or is identical to a sequence of AGAGTGAAGT TCAGCAGGAG CGCAGACGCC CCCGCGTACC AGCAGGGCCA GAACCAGCTC TATAACGAGC TCAATCTAGG ACGAAGAGAG GAGTACGATG TTTTGCACAT GCAGGCCCTG CCCCCTCGC (SEQ ID NO: 18). In some embodiments, the CD3ζ activation domain is encoded by SEQ ID NO: 18.

In some embodiments, the cytoplasmic domain of the CAR can be designed to comprise the CD3ζ signaling domain by itself or combined with any other desired cytoplasmic domain(s) useful in the context of the CAR of the instant disclosure. For example, the cytoplasmic domain of the CAR can comprise a CD3ζ chain portion and a co-stimulatory domain. The co-stimulatory domain refers to a portion of the CAR comprising the intracellular domain of a costimulatory molecule. A costimulatory molecule is a cell surface molecule other than an antigen receptor or its ligands that is required for an efficient response of lymphocytes to an antigen. Examples of such molecules include the co-stimulatory domain is selected from the group consisting of IL-2Rβ, Fc Receptor gamma (FcRγ), Fc Receptor beta (FcRβ), CD3g molecule gamma (CD3γ), CD3δ, CD3ε, CD5 molecule (CD5), CD22 molecule (CD22), CD79a molecule (CD79a), CD79b molecule (CD79b), carcinoembryonic antigen related cell adhesion molecule 3 (CD66d), CD27 molecule (CD27), CD28 molecule (CD28), TNF receptor superfamily member 9 (4-1BB), TNF receptor superfamily member 4 (OX40), TNF receptor superfamily member 8 (CD30), CD40 molecule (CD40), programmed cell death 1 (PD-1), inducible T cell costimulatory (ICOS), lymphocyte function-associated antigen-1 (LFA-1), CD2 molecule (CD2), CD7 molecule (CD7), TNF superfamily member 14 (LIGHT), killer cell lectin like receptor C2 (NKG2C) and CD276 molecule (B7-H3) c-stimulatory domains, or functional variants thereof. In some embodiments, the intracellular domains of CARs of the instant disclosure comprise at least one co-stimulatory domain. In some embodiments, the co-stimulatory domain is isolated or derived from CD28.

In some embodiments, the intracellular domains of CARs of the instant disclosure comprise at least one co-stimulatory domain. In some embodiments, the co-stimulatory domain is isolated or derived from CD28. In some embodiments, the CD28 co-stimulatory domain comprises an amino acid sequence having at least 80% identity, at least 90% identity, at least 95% identity, at least 99% identity or is identical to a sequence of RSKRSRLLHSDYMNMTPRRPGP-TRKHYQPYAPPRDFAAYRS (SEQ ID NO: 19). In some embodiments, the CD28 co-stimulatory domain comprises or consists essentially of SEQ ID NO: 19. In some embodiments, the CD28 co-stimulatory domain is encoded by a nucleotide sequence having at least 80% identity, at least 90% identity, at least 95% identity, at least 99% identity or is identical to a sequence of AGGAGCAAGCGGAGCA-GACTGCTGCACAGCGACTACATGAA-CATGACCCCCCGG AGGCCTGGCCCCACCCG-GAAGCACTACCAGCCCTACGCCCCTCCCAGGGATT TCG CCGCCTACCGGAGC (SEQ ID NO: 20). In some embodiments, the CD28 co-stimulatory domain is encoded by SEQ ID NO: 20.

In some embodiments, the co-stimulatory domain is isolated or derived from 4-1BB. In some embodiments, the 4-1BB co-stimulatory domain comprises an amino acid sequence having at least 80% identity, at least 90% identity, at least 95% identity, at least 99% identity or is identical to a sequence of KRGRKKLLY-IFKQPFMRPVQTTQEEDGCSCRFPEEEEGGCEL (SEQ ID NO: 283). In some embodiments, the 4-1BB co-stimulatory domain comprises or consists essentially of KRGRKKLLY-IFKQPFMRPVQTTQEEDGCSCRFPEEEEGGCEL (SEQ ID NO: 283). In some embodiments, the 4-1BB co-stimulatory domain s encoded by a nucleotide sequence having at least 80% identity, at least 90% identity, at least 95% identity, at least 99% identity or is identical to a sequence of AAACGGGGCAGAAAGAAACTCCTGTATATATT-CAAACAACCATTTATGAGGCCA GTACAAACTACT-CAAGAGGAAGATGGCTGTAGCTGCCGAT-TTCCAGAAGAAGAA GAAGGAGGATGTGAACTG (SEQ ID NO: 284).

In some embodiments, the intracellular domain of the CAR comprises a CD28 co-stimulatory domain, a 4-1BB costimulatory domain, and a CD3ζ activation domain. In some embodiments, the intracellular domain of the CAR comprises a sequence of RSKRSRLLHSDYMNMT-PRRPGPTRKHYQPYAPPRDFAAYRSKRGRKKLLY-IFKQPF MRPVQTTQEEDGCSCRFPEEEEGGCELRVKFSRS-ADAPAYKQGQNQLYNELNLGRR EEYDVLDKRR-GRDPEMGGKPRRKNPQEGLYNELQKDKMAEAYSEI-GMKGERRRGK GHDGLYQGLSTATKDTYDALHMQALPPR (SEQ ID NO: 285), or a sequence having at least 80% identity, at least 90% identity, at least 95% identity, at least 99% identity thereto.

The cytoplasmic domains within the cytoplasmic signaling portion of the CARs of the instant disclosure may be linked to each other in a random or specified order. Optionally, a short oligo- or polypeptide linker, for example between 2 and 10 amino acids in length may form the linkage. A glycine-serine doublet provides an example of a suitable linker. An exemplary linker comprises a sequence of GGGGSGGGGSGGGGSGG (SEQ ID NO: 152).

The cytoplasmic domains within the cytoplasmic signaling portion of the CARs of the instant disclosure may be linked to each other in a random or specified order. Optionally, a short oligo- or polypeptide linker, for example between 2 and 10 amino acids in length may form the linkage. A glycine-serine doublet provides an example of a suitable linker. Exemplary full length activator receptors of the disclosure are described in Table 20. In some embodiments, the first activator receptor comprises a sequence of SEQ ID NOS: 286-347, as set forth in Table 20, or a sequence having at least 90%, at least 95%, at least 97% or at least 99% identity thereto. In some embodiments, the first activator receptor comprises a sequence of SEQ ID NOS: 286-347, as set forth in Table 20. In some embodiments, the first activator receptor comprises a sequence of SEQ ID NO: 288, or a sequence having at least 90%, at least 95%, at least 97% or at least 99% identity thereto. In some embodiments, the first activator receptor comprises a sequence of SEQ ID NO: 297, or a sequence having at least 90%, at least 95%, at least 97% or at least 99% identity thereto. In some embodiments, the first activator receptor comprises a sequence of SEQ ID NO: 301, or a sequence having at least 90%, at least 95%, at least 97% or at least 99% identity thereto. In some embodiments, the first activator receptor comprises a sequence of SEQ ID NO: 302, or a sequence having at least 90%, at least 95%, at least 97% or at least 99% identity thereto. In some embodiments, the first activator receptor comprises a sequence of SEQ ID NO: 303, or a sequence having at least 90%, at least 95%, at least 97% or at least 99% identity thereto. In some embodiments, the first activator receptor comprises a sequence of SEQ ID NO: 314, or a sequence having at least 90%, at least 95%, at least 97% or at least 99% identity thereto. In some embodiments, the first activator receptor comprises a sequence of SEQ ID NO: 335, or a sequence having at least 90%, at least 95%, at least 97% or at least 99% identity thereto. In some embodiments, the first activator receptor comprises a sequence of SEQ ID NO: 340, or a sequence having at least 90%, at least 95%, at least 97% or at least 99% identity thereto. In some embodiments, the first activator receptor comprises a sequence of SEQ ID NO: 344, or a sequence having at least 90%, at least 95%, at least 97% or at least 99% identity thereto.

The cytoplasmic domains within the cytoplasmic signaling portion of the CARs of the instant disclosure may be linked to each other in a random or specified order. Optionally, a short oligo- or polypeptide linker, for example between 2 and 10 amino acids in length may form the linkage. A glycine-serine doublet provides an example of a suitable linker.

T Cell Receptors (TCRs)

The disclosure provides a first, activator receptor and immune cells comprising same. In some embodiments, the first receptor is a T cell receptor (TCR).

As used herein, a "TCR", sometimes also called a "TCR complex" or "TCR/CD3 complex" refers to a protein complex comprising a TCR alpha chain, a TCR beta chain, and one or more of the invariant CD3 chains (zeta, gamma, delta and epsilon), sometimes referred to as subunits. The TCR alpha and beta chains can be disulfide-linked to function as a heterodimer to bind to peptide-MHC complexes. Once the TCR alpha/beta heterodimer engages peptide-MHC, conformational changes in the TCR complex in the associated invariant CD3 subunits are induced, which leads to their phosphorylation and association with downstream proteins, thereby transducing a primary stimulatory signal. In an exemplary TCR complex, the TCR alpha and TCR beta polypeptides form a heterodimer, CD3 epsilon and CD3 delta form a heterodimer, CD3 epsilon and CD3 gamma for a heterodimer, and two CD3 zeta form a homodimer.

Any suitable ligand binding domain may be fused to an extracellular domain, hinge domain or transmembrane of the TCRs described herein. For example, the ligand binding domain can be an antigen binding domain of an antibody or TCR, or comprise an antibody fragment, a Vβ only domain, a linear antibody, a single-chain variable fragment (scFv), or a single domain antibody (sdAb).

In some embodiments, the ligand binding domain is fused to one or more extracellular domains or transmembrane domains of one or more TCR subunits. The TCR subunit can be TCR alpha, TCR beta, CD3 delta, CD3 epsilon, CD3 gamma or CD3 zeta. For example, the ligand binding domain can be fused to TCR alpha, or TCR beta, or portions of the ligand binding can be fused to two subunits, for example portions of the ligand binding domain can be fused to both TCR alpha and TCR beta.

TCR subunits include TCR alpha, TCR beta, CD3 zeta, CD3 delta, CD3 gamma and CD3 epsilon. Any one or more of TCR alpha, TCR beta chain, CD3 gamma, CD3 delta, CD3 epsilon, or CD3 zeta, or fragments or derivative thereof, can be fused to one or more domains capable of providing a stimulatory signal of the disclosure, thereby enhancing TCR function and activity.

TCR transmembrane domains isolated or derived from any source are envisaged as within the scope of the disclosure. The transmembrane domain may be derived either from a natural or from a recombinant source. Where the source is natural, the domain may be derived from any membrane-bound or transmembrane protein.

In some embodiments, the transmembrane domain is capable of signaling to the intracellular domain(s) whenever the TCR complex has bound to a target. A transmembrane domain of particular use in this disclosure may include at least the transmembrane region(s) of e.g., the alpha, beta or zeta chain of the TCR, CD3 delta, CD3 epsilon or CD3 gamma, CD28, CD3 epsilon, CD45, CD4, CD5, CD8, CD9, CD16, CD22, CD33, CD37, CD64, CD80, CD86, CD134, CD137, CD154.

In some embodiments, the transmembrane domain can be attached to the extracellular region of a polypeptide of the TCR, e.g., the antigen binding domain of the TCR alpha or beta chain, via a hinge, e.g., a hinge from a human protein. For example, the hinge can be a human immunoglobulin (Ig) hinge, e.g., an IgG4 hinge, or a CD8α hinge. In some embodiments, the hinge is isolated or derived from CD8α or CD28.

In some embodiments, the extracellular ligand binding domain is attached to one or more transmembrane domains of the TCR. In some embodiments, the transmembrane domain comprises a TCR alpha transmembrane domain, a TCR beta transmembrane domain, or both. In some embodiments, the transmembrane comprises a CD3 zeta transmembrane domain.

A transmembrane domain can include one or more additional amino acids adjacent to the transmembrane region, e.g., one or more amino acid associated with the extracellular region of the protein from which the transmembrane was derived (e.g., 1, 2, 3, 4, 5, 6, 7, 8, 9, 10 or up to 15 amino acids of the extracellular region) and/or one or more additional amino acids associated with the intracellular region of the protein from which the transmembrane protein is derived (e.g., 1, 2, 3, 4, 5, 6, 7, 8, 9, 10 or up to 15 amino acids of the intracellular region).

In some embodiments, the transmembrane domain can be selected or modified by amino acid substitution to avoid binding of such domains to the transmembrane domains of the same or different surface membrane proteins, e.g., to minimize interactions with other members of the receptor complex.

When present, the transmembrane domain may be a natural TCR transmembrane domain, a natural transmembrane domain from a heterologous membrane protein, or an artificial transmembrane domain. The transmembrane domain may be a membrane anchor domain. Without limitation, a natural or artificial transmembrane domain may comprise a hydrophobic a-helix of about 20 amino acids, often with positive charges flanking the transmembrane segment. The transmembrane domain may have one transmembrane segment or more than one transmembrane segment. Prediction of transmembrane domains/segments may be made using publicly available prediction tools (e.g.

TMHMM, Krogh et al. Journal of Molecular Biology 2001; 305(3):567-580; or TMpred, Hofmann & Stoffel Biol. Chem. Hoppe-Seyler 1993; 347: 166). Non-limiting examples of membrane anchor systems include platelet derived growth factor receptor (PDGFR) transmembrane domain, glycosylphosphatidylinositol (GPI) anchor (added post-translationally to a signal sequence) and the like.

In some embodiments, the transmembrane domain comprises a TCR alpha transmembrane domain. In some embodiments, the TCR alpha transmembrane domain comprises an amino acid sequence having at least 85% identity, at least 90% identity, at least 95% identity, at least 96% identity, at least 97% identity, at least 98% identity, at least 99% identity or is identical to a sequence of: VIGFRILLLK-VAGFNLLMTLRLW (SEQ ID NO: 21). In some embodiments, the TCR alpha transmembrane domain comprises, or consists essentially of, SEQ ID NO: 21. In some embodiments, the TCR alpha transmembrane domain is encoded by a sequence of GTGATTGGGTTCCGAATCCTCCTCCT-GAAAGTGGCCGGGTTTAATCTGCTCATGA CGCTGCGGCTGTGG (SEQ ID NO: 22).

In some embodiments, the transmembrane domain comprises a TCR beta transmembrane domain. In some embodiments, the TCR beta transmembrane domain comprises an amino acid sequence having at least 85% identity, at least 90% identity, at least 95% identity, at least 96% identity, at least 97% identity, at least 98% identity, at least 99% identity or is identical to a sequence of: TILYEILLGKAT-LYAVLVSALVL (SEQ ID NO: 23). In some embodiments, the TCR beta transmembrane domain comprises, or consists essentially of, SEQ ID NO: 23. In some embodiments, the TCR beta transmembrane domain is encoded by a sequence of ACCATCCTCTATGAGATCTTGCTAGGGAAGGC-CACCTTGTATGCCGTGCTGGTCAGTGCCCTCGTGC TG (SEQ ID NO: 24).

TCRs of the disclosure can comprise one or more intracellular domains. Exemplary TCRs comprising intracellular domains for use in the instant disclosure are described in PCT/US2020/045250 filed on Sep. 6, 2020, the contents of which are incorporated herein by reference. In some embodiments, the intracellular domain comprises one or more domains capable of providing a stimulatory signal to a transmembrane domain. In some embodiments, the intracellular domain comprises a first intracellular domain capable of providing a stimulatory signal and a second intracellular domain capable of providing a stimulatory signal. In other embodiments, the intracellular domain comprises a first, second and third intracellular domain capable of providing a stimulatory signal. The intracellular domains capable of providing a stimulatory signal are selected from the group consisting of a CD28 molecule (CD28) domain, a LCK proto-oncogene, Src family tyrosine kinase (Lck) domain, a TNF receptor superfamily member 9 (4-1BB) domain, a TNF receptor superfamily member 18 (GITR) domain, a CD4 molecule (CD4) domain, a CD8α molecule (CD8a) domain, a FYN proto-oncogene, Src family tyrosine kinase (Fyn) domain, a zeta chain of T cell receptor associated protein kinase 70 (ZAP70) domain, a linker for activation of T cells (LAT) domain, lymphocyte cytosolic protein 2 (SLP76) domain, (TCR) alpha, TCR beta, CD3 delta, CD3 gamma and CD3 epsilon intracellular domains.

In some embodiments, an intracellular domain comprises at least one intracellular signaling domain. An intracellular signaling domain generates a signal that promotes a function a cell, for example an immune effector function of a TCR containing cell, e.g., a TCR-expressing T-cell. In some embodiments, the intracellular domain of the first receptor of the disclosure includes at least one intracellular signaling domain. For example, the intracellular domains of CD3 gamma, delta or epsilon comprise signaling domains.

In some embodiments, the extracellular domain, transmembrane domain and intracellular domain are isolated or derived from the same protein, for example T-cell receptor (TCR) alpha, TCR beta, CD3 delta, CD3 gamma, CD3 epsilon or CD3 zeta.

Examples of intracellular domains for use in activator receptors of the disclosure include the cytoplasmic sequences of the TCR alpha, TCR beta, CD3 zeta, and 4-1BB, and the intracellular signaling co-receptors that act in concert to initiate signal transduction following antigen receptor engagement, as well as any derivative or variant of these sequences and any recombinant sequence that has the same functional capability.

In some embodiments, the intracellular signaling domain comprises a primary intracellular signaling domain. Exemplary primary intracellular signaling domains include those derived from the proteins responsible for primary stimulation, or antigen dependent stimulation.

In some embodiments, the intracellular domain comprises a CD3 delta intracellular domain, a CD3 epsilon intracellular domain, a CD3 gamma intracellular domain, a CD3 zeta intracellular domain, a TCR alpha intracellular domain or a TCR beta intracellular domain.

In some embodiments, the intracellular domain comprises a TCR alpha intracellular domain. In some embodiments, a TCR alpha intracellular domain comprises Ser-Ser. In some embodiments, a TCR alpha intracellular domain is encoded by a sequence of TCCAGC.

In some embodiments, the intracellular domain comprises a TCR beta intracellular domain. In some embodiments, the TCR beta intracellular domain comprises an amino acid sequence having at least 80% identity, at least 90% identity, or is identical to a sequence of: MAMVKRKDSR (SEQ ID NO: 25). In some embodiments, the TCR beta intracellular domain comprises, or consists essentially of SEQ ID NO: 25. In some embodiments, the TCR beta intracellular domain is encoded by a sequence of ATGGCCATGGT-CAAGAGAAAGGATTCCAGA (SEQ ID NO: 26).

In some embodiments, the intracellular signaling domain comprises at least one stimulatory intracellular domain. In some embodiments, the intracellular signaling domain comprises a primary intracellular signaling domain, such as a CD3 delta, CD3 gamma and CD3 epsilon intracellular domain, and one additional stimulatory intracellular domain, for example a co-stimulatory domain. In some embodiments, the intracellular signaling domain comprises a primary intracellular signaling domain, such as a CD3 delta, CD3 gamma and CD3 epsilon intracellular domain, and two additional stimulatory intracellular domains.

Exemplary co-stimulatory intracellular signaling domains include those derived from proteins responsible for co-stimulatory signals, or antigen independent stimulation. Co-stimulatory molecules include, but are not limited to an MHC class I molecule, BTLA, a Toll ligand receptor, as well as DAP10, DAP12, CD30, LIGHT, OX40, CD2, CD27, CDS, ICAM-1, LFA-1 (CD11a/CD18) 4-1BB (CD137, TNF receptor superfamily member 9), and CD28 molecule (CD28). A co-stimulatory protein can be represented in the following protein families: TNF receptor proteins, Immunoglobulin-like proteins, cytokine receptors, integrins, signaling lymphocytic activation molecules (SLAM proteins), and activating NK cell receptors. Examples of such molecules include CD27, CD28, 4-1BB (CD137), OX40, GITR, CD30, CD40, ICOS, BAFFR, HVEM, lymphocyte function-associated antigen-1 (LFA-1), CD2, CD7, LIGHT, NKG2C, SLAMF7, NKp80, CD160, B7-H3, a ligand that specifically binds with CD83, CD4, and the like. The co-stimulatory domain can comprise the entire intracellular portion, or the entire native intracellular signaling domain, of the molecule from which it is derived, or a functional variant thereof.

In some embodiments, the stimulatory domain comprises a co-stimulatory domain. In some embodiments, the co-stimulatory domain comprises a CD28 or 4-1BB co-stimulatory domain. CD28 and 4-1BB are well characterized co-stimulatory molecules required for full T cell activation and known to enhance T cell effector function. For example, CD28 and 4-1BB have been utilized in chimeric antigen receptors (CARs) to boost cytokine release, cytolytic function, and persistence over the first-generation CAR containing only the CD3 zeta signaling domain. Likewise, inclusion of co-stimulatory domains, for example CD28 and 4-1BB domains, in TCRs can increase T cell effector function and specifically allow co-stimulation in the absence of co-stimulatory ligand, which is typically down-regulated on the surface of tumor cells. In some embodiments, the stimulatory domain comprises a CD28 intracellular domain or a 4-1BB intracellular domain.

Inhibitory Receptors

The disclosure provides a second receptor, comprising an extracellular ligand binding domain specific to a non-target antigen that has been lost in a cancer cell, such as an allelic variant of a gene. The non-target allelic variant can be lost in the cancer cell through any mechanism, such as, without limitation, epigenetic changes that effect non-target allelic variant expression, mutations to the gene encoding the non-target allelic variant, disruption of cellular signaling that regulates expression of the non-target allelic variant, chromosome loss, partial or complete deletion of the genomic locus, gene silencing through modification of nucleic acids or heterochromatin, or loss of expression through other mechanisms. In variations of the compositions and methods disclosed herein, the cells or subject treated may exhibit a loss of expression of the non-target allelic variant because of non-genetic changes. Accordingly the disclosure provides compositions and methods for killing cells and/or treating subject lacking expression of the non-target antigen from any cause, including but not limited to, loss of heterozygosity.

The non-target antigen can be a protein, or an antigen peptide thereof in a complex with a major histocompatibility complex class I (MHC-I), where the non-target antigen comprises a polymorphism. Because the non-target antigen is polymorphic, loss of a single copy of the gene encoding the non-target antigen, which may occur through loss of heterozygosity in a cancer cell, yields a cancer cell that retains the other polymorphic variant of gene, but has lost the non-target antigen. For example, a subject having HLA-A*02 and HLA-A*01 alleles at the HLA locus may have a cancer in which only the HLA-A*02 allele is lost. In such a subject, the HLA-A*01 protein remains present, but is not recognized by the inhibitory receptor of immune cells encountering the cancer cell, because the inhibitor receptor is designed to be specific to the HLA-A*02 (or other non-target antigen). In normal non-malignant cells, the HLA-A*02 (or other non-target antigen) is present and inhibits activation of the engineered immune cell. In cancer cells having loss of heterozygosity, the HLA-A*02 allelic variant (or other non-target antigen) is lost. Immune cells engineered to express the inhibitory receptor do not receive an inhibitory signal from the inhibitory receptor, as the inhibitory receptor only responds to the HLA-A*02 (or other non-target antigen), which is absent on cancer cells. By this mechanism, the immune cell is selectively activated, and selectively kills, cancer cells expressing MSLN but having lost HLA-A*02 (or another non-target antigen) due to loss-of-heterozygosity. HLA-A is used here as an example. Similar polymorphic variation occurs in the population at other MHC genes and in other non-MHC genes as well. Accordingly, the disclosure provides a second receptor, comprising an extracellular ligand binding domain specific to a non-target antigen selected from intercellular adhesion molecule 1 (ICAM1), catechol-O-methyltransferase (COMT), C—X—C motif chemokine ligand 16 (CXCL16), leucine rich repeat neuronal 4 (LRRN4) and uroplakin 3B (UPK3B), or an antigen peptide thereof in a complex with a major histocompatibility complex class I (MHC-I), wherein the non-target antigen may comprise a nonsynonymous, extracellular-domain polymorphism (e.g., in an extracellular domain of ICAM1, COMT, CXCL16), and immune cells comprising same. In some embodiments, the second receptor is an inhibitory chimeric antigen receptor. Alternatively, the non-target antigen may comprise a protein whose expression is lost in tumors, but present in key MSLN-expression normal tissues (e.g., LRRN4, UPK3B).

Exemplary inhibitory receptors are described in PCT/US2020/045228 filed on Sep. 6, 2020, PCT/US2020/064607, filed on Dec. 11, 2020, PCT/US2021/029907, filed on Apr. 29, 2021 and PCT/US2020/059856 filed on Nov. 10, 2020, the contents of each of which are incorporated herein by reference.

In some embodiments, the second receptor is humanized.

The disclosure provides a second receptor, which is an inhibitory receptor, comprising an extracellular ligand binding that can discriminate between single amino-acid variant alleles of a non-target antigen. This ability to discriminate between allelic variants of a non-target antigen allows the second receptor to inhibit activation of immune cells comprising the second receptor in the presence of non-target cells that express that the allele recognized by the ligand binding domain. However, activation of immune cells is not inhibited in the presence of target cells that have lost the allele, for example cancer cells that have lost one allele of a gene through loss of heterozygosity.

The disclosure provides a second receptor, which is an inhibitory receptor, comprising an extracellular ligand binding that can discriminate between different levels of expression of a non-target antigen. This allows the second receptor to inhibit activation of immune cells comprising the second receptor in the presence of non-target cells that express the ligand for the second receptor, but to allow activation of immune cells in the presence of cancer cells that express low levels, or have no expression, of the ligand for the second receptor.

Inhibitor Ligands

In some embodiments, the non-target antigen is not expressed by the target cells, and is expressed by non-target cells. In some embodiments, the non-target antigen is expressed by healthy cells, i.e. cells that are not cancer cells. In some embodiments, the target cells are a plurality of cancer cells that have lost expression of the non-target antigen through loss of heterozygosity (LOH). In some embodiments, the non-target cells are a plurality of healthy cells (i.e., non-cancer cells), that express both the target and the non-target antigen.

Any cell surface molecule expressed by the non-target cells that is not expressed by target cells may be a suitable non-target antigen for the second receptor extracellular ligand binding domain. For example, a cell adhesion molecule, a cell-cell signaling molecule, an extracellular domain, a molecule involved in chemotaxis, a glycoprotein, a G protein-coupled receptor, a transmembrane, a receptor for a neurotransmitter or a voltage gated ion channel can be used as a non-target antigen.

prises an allele of HLA-A. in some embodiments, the allele of HLA-A comprises HLA-A*01, HLA-A*02, HLA-A*03 or HLA-A*11. In some embodiments, the non-target antigen comprises HLA-A*69. In some embodiments, the non-target antigen comprises a human leukocyte antigen A*02 allele (HLA-A*02).

In some embodiments, the non-target antigen comprises an allele of HLA-B. In some embodiments, the allele of HLA-B comprises HLA-B*07.

In some embodiments, the non-target antigen comprises HLA-C. In some embodiments, the HLA-C allele comprises HLA-C*07.

In some embodiments, the non-target antigen comprises ICAM1 or an antigen peptide thereof in a complex with MHC-I. Human ICAM1 is frequently lost through LOH in cancer cells.

A wild type Human ICAM1 is described in NCBI record number NP_000192.2 the contents of which are incorporated by reference herein in their entirety. In some embodiments, ICAM1 comprises an amino acid sequence of:

```
                                                                    (SEQ ID NO 27)
  1  MAPSSPRPAL  PALLVLLGAL  FPGPGNAQTS  VSPSKVILPR  GGSVLVTCST  SCDQPKLLGI

61  ETPLPKKELL  LPGNNRKVYE  LSNVQEDSQP  MCYSNCPDGQ  STAKTFLTVY  WTPERVELAP

121  LPSWQPVGKN  LTLRCQVEGG  APRANLTVVL  LRGEKELKRE  PAVGEPAEVT  TTVLVRRDHH

181  GANFSCRTEL  DLRPQGLELF  ENTSAPYQLQ  TFVLPATPPQ  LVSPRVLEVD  TQGTVVCSLD

241  GLFPVSEAQV  HLALGDQRLN  PTVTYGNDSF  SAKASVSVTA  EDEGTQRLTC  AVILGNQSQE

301  TLQTVTIYSF  PAPNVILTKP  EVSEGTEVTV  KCEAHPRAKV  TLNGVPAQPL  GPRAQLLLKA

361  TPEDNGRSFS  CSATLEVAGQ  LIHKNQTREL  RVLYGPRLDE  RDCPGNWTWP  ENSQQTPMCQ

421  AWGNPLPELK  CLKDGTFPLP  IGESVTVTRD  LEGTYLCRAR  STQGEVTRKV  TVNVLSPRYE

481  IVIITVVAAA  VIMGTAGLST  YLNRQRKIK   KYRLQQAQKG  TPMKPNTQAT  PP.
```

In some embodiments, the target antigen is a peptide antigen of a cancer cell-specific antigen in a complex with a major histocompatibility complex class I (MHC-I).

In some embodiments, the non-target antigen is lost in the cancer cells due to loss of heterozygosity. Exemplary non-target antigens lost in cancer cells due to loss of heterozygosity include ICAM1, COMT and CXCL16. In some embodiments, the non-target antigen is selected from the group consisting of a polymorphic variant of ICAM1, COMT and CXCL16. IN some embodiments, the non-target antigen is an antigen peptide comprising a polymorphic residue of ICAM1, COMT or CXCL16 in a complex with a major histocompatibility complex class I (MHC-I).

Non-target major histocompatibility complex class I MHC-I (or pMHC-I) antigens comprising any of HLA-A, HLA-B, HLA-C or HLA-E are envisaged as within the scope of the disclosure. In some embodiments, the non-target antigen comprises a Major Histocompatibility Complex (MHC) protein. In some embodiments, the MHC is MHC class I. In some embodiments, the MHC class I protein comprises a human leukocyte antigen (HLA) protein. In some embodiments, the non-target antigen comprises an allele of an HLA Class I protein selected from the group consisting of HLA-A, HLA-B, HLA-C, or HLA-E. In some embodiments, the HLA-A allele comprises HLA-A*01, HLA-A*02, HLA-A*03 or HLA-A*11. In some embodiments, the HLA-B allele comprises HLA-B*07. In some embodiments, the HLA-C allele comprises HLA-C*07.

In some embodiments, the non-target antigen comprises HLA-A. In some embodiments, the non-target antigen com- In some embodiments, ICAM1 comprises a sequence that shares at least 80%, at least 85%, at least 90%, at least 95%, at least 96%, at least 97%, at least 98%, or at least 99% identity to SEQ ID NO: 27. Polymorphic residues of ICAM1 are marked as bold and underlined in SEQ ID NO: 27. For example, rs5498 is a polymorphism at position 469 of SEQ ID NO: 27, which can be a K or an E.

In some embodiments, the non-target antigen comprises a polymorphism of ICAM1. For example, the non-target antigen comprises a peptide derived from ICAM1 comprising a polymorphic residue of ICAM1. Polymorphic residues of ICAM1 include amino acid residue 469 of SEQ ID NO: 27. In some embodiments, the non-target antigen comprises a peptide of ICAM1 comprising amino acid 469 of SEQ ID NO: 27. In some embodiments, the non-target antigen comprises a K at position 469 of SEQ ID NO: 27. In some embodiments, the non-target antigen comprises an E at position 469 of SEQ ID NO: 27.

In some embodiments, the non-target antigen comprises an ICAM1 polymorphism with an K at position 469 of SEQ ID NO: 27, and the second receptor comprises a ligand binding domain with a higher affinity for an ICAM1 ligand with an K at position 469 of SEQ ID NO: 27 than for an ICAM1 ligand with an E at position 469 of SEQ ID NO: 27. In some embodiments, the non-target antigen comprises an ICAM1 polymorphism with an E at position 469 of SEQ ID NO: 27, and the second receptor comprises a ligand binding domain with a higher affinity for an ICAM1 ligand with an E at position 469 of SEQ ID NO: 27 than for an ICAM1 ligand with a K at position 469 of SEQ ID NO: 27.

In some embodiments, the non-target antigen comprises COMT or an antigen peptide thereof in a complex with MHC-I. Human COMT is frequently lost through LOH in cancer cells.

A wild type Human COMT is described in NCBI record number NP_000192.2, the contents of which are incorporated by reference herein in their entirety. In some embodiments. COMT comprises an amino acid sequence of:

(SEQ ID NO: 28)

```
1    MPEAPPLLLA AVLLGLVLLV VLLLLLRHWG WGLCLIGWNE FILQPIHNLL MGDTKEQRIL

61   NHVLQHAEPG NAQSVLEAID TYCEQKEWAM NVGDKKGKIV DAVIQEHQPS VLLELGAYCG

121  YSAVRMARLL SPGARLITIE INPDCAAITQ RMVDFAGVKD KVTLVVGASQ DIIPQLKKKY

181  DVDTLDMVFL DHWKDRYLPD TLLLEECGLL RKGTVLLADN VICPGAPDFL AHVRGSSCFE

241  CTHYQSFLEY REVVDGLEKA IYKGPGSEAG P.
```

In some embodiments, COMT comprises a sequence that shares at least 80%, at least 85%, at least 90%, at least 95%, at least 96%, at least 97%, at least 98%, or at least 99% identity to SEQ ID NO: 28. Polymorphic residues of COMT are marked as bold and underlined in SEQ ID NO: 28. For example, V158M is a polymorphism at position 158 of SEQ ID NO: 28, which can be a V or an M.

In some embodiments, the non-target antigen comprises a polymorphism of COMT. For example, the non-target antigen comprises a peptide derived from COMT comprising a polymorphic residue of COMT. Polymorphic residues of COMT 1 include amino acid residue 158 of SEQ ID NO: 28. In some embodiments, the non-target antigen comprises a peptide of COMT comprising amino acid 158 of SEQ ID NO: 28. In some embodiments, the non-target antigen comprises a V at position 158 of SEQ ID NO: 28. In some embodiments, the non-target antigen comprises an M at position 158 of SEQ ID NO: 28.

In some embodiments, the non-target antigen comprises a COMT polymorphism with a V at position 158 of SEQ ID NO: 28, and the second receptor comprises a ligand binding domain with a higher affinity for a COMT ligand with an V at position 158 of SEQ ID NO: 28 than for a COMT ligand with an M at position 158 of SEQ ID NO: 28. In some embodiments, the non-target antigen comprises a COMT polymorphism with a M at position 158 of SEQ ID NO: 28, and the second receptor comprises a ligand binding domain with a higher affinity for a COMT ligand with an M at position 158 of SEQ ID NO: 28 than for a COMT ligand with a V at position 158 of SEQ ID NO: 28.

In some embodiments, the non-target antigen comprises C—X—C motif chemokine ligand 16 (CXCL16) or an antigen peptide thereof in a complex with MHC-I. Human CXCL16 precursor is described in NCBI record number NP_001094282.1, the contents of which are incorporated by reference herein in their entirety. In some embodiments, CXCL16 comprises an amino acid sequence of:

In some embodiments, the non-target antigen comprises a polymorphism of CXCL16. For example, the non-target antigen comprises a peptide derived from CXCL16 comprising a polymorphic residue of CXCL16. Polymorphic residues of CXCL16 include positions 142 and 200 of SEQ ID NO: 29. In some embodiments, the non-target antigen comprises a peptide of CXCL16 comprising amino acid 142 or 200 of SEQ ID NO: 29. In some embodiments, the non-target antigen comprises a peptide of CXCL16 comprising an A at amino acid 200 of SEQ ID NO: 29. In some embodiments, the non-target antigen comprises a peptide of CXCL16 comprising a V at amino acid 200 of SEQ ID NO: 29. In some embodiments, the non-target antigen comprises a peptide of CXCL16 comprising an I at amino acid 142 of SEQ ID NO: 29. In some embodiments, the non-target antigen comprises a peptide of CXCL16 comprising a T at amino acid 142 of SEQ ID NO: 29.

In some embodiments, the non-target antigen comprises a polymorphism of CXCL16. In some embodiments, the non-target antigen comprises a peptide of CXCL16 comprising an A at amino acid 200 of SEQ ID NO: 29, and the second receptor comprises a ligand binding domain with a higher affinity for a CXCL16 ligand with an A at position 200 of SEQ ID NO: 29 than for a CXCL16 ligand with a V at position 200 of SEQ ID NO: 29. In some embodiments, the non-target antigen comprises a peptide of CXCL16 comprising a V at amino acid 200 of SEQ ID NO: 29, and the second receptor comprises a ligand binding domain with a higher affinity for a CXCL16 ligand with a V at position 200 of SEQ ID NO: 29 than for a CXCL16 ligand with an A at position 200 of SEQ ID NO: 29. In some embodiments, the non-target antigen comprises a peptide of CXCL16 comprising an I at amino acid 142 of SEQ ID NO: 29, and the second receptor comprises a ligand binding domain with a higher affinity for a CXCL16 ligand with an I at position 142 of SEQ ID NO: 29 than for a CXCL16 ligand with a T at position 142 of SEQ ID NO: 29. In some embodiments, the non-target antigen comprises a peptide of CXCL16 comprising a T at amino acid 142 of SEQ ID NO: 29, and the second receptor comprises a ligand binding domain with a higher affinity for a CXCL16 ligand with a T at position 142 of SEQ ID NO: 29 than for a CXCL16 ligand with an I at position 142 of SEQ ID NO: 29.

In some embodiments, the non-target antigen comprises HLA-A*01, HLA-A*02, HLA-A*03, HLA-A*11, HLA- (SEQ ID NO: 29)

```
1    MSGSQSEVAP SPQSPRSPEM GRDLRPGSRV LLLLLLLLLV YLTQPGNGNE GSVTGSCYCG

61   KRISSDSPPS VQFMNRLRKH LRAYHRCLYY TRFQLLSWSV CGGNKDPWVQ ELMSCLDLKE

121  CGHAYSGIVA HQKHLLPTSP PISQASEGAS SDIHTPAQML LSTLQSTQRP TLPVGSLSSD

181  KELTRPNETT IHTAGHSLAA GPEAGENQKQ PEKNAGPTAR TSATVPVLCL LAIIEILTAA

241  LSYVLCKRRR GQSPQSSPDL PVHYIPVAPD SNT.
```

B*07 or HLA-C*07. Various single variable domains that bind to or recognize the specified HLA alleles, for use in embodiments described herein, are described in Table 5. (complementarity determining regions underlined):

TABLE 5

| HLA scFv binding domains |  |
|---|---|
| HLA-A*02 antigen binding domains | |
| DVLMTQTPLSLPVSL GDQASISC<u>RSSQSIVH SNGNTYLE</u>WYLQKP GQSPKLLIY<u>KVSNRF</u> SGVPDRFSGSGSGTD FTLKISRVEAEDLGV YYC<u>FQGSHVPRT</u>SGG GTKLEIKGGGGSGGG GSGGGGSGGQVQLQ QSGPELVKPGASVRI SCK<u>ASGYTFTSYHIH</u> WVKQRPGQGLEWIG <u>WIYPGNVNTEYNEK FKGK</u>ATLTADKSSST AYMHLSSLTSEDSAV YFCAR<u>EEITYAMDY</u> WGQGTSVTVSS (SEQ ID NO: 30) | GATGTTTTGATGACCCAAACTCCACTCTCCCTGCCT GTCAGTCTTGGAGATCAAGCCTCCATCTCTTGCAG ATCTAGTCAGAGCATTGTACATAGTAATGGAAACA CCTATTTAGAATGGTACCTGCAGAAACCAGGCCAG TCTCCAAAGCTCCTGATCTACAAAGTTTCCAACCG ATTTTCTGGGGTCCCAGACAGGTTCAGTGGCAGTG GATCAGGGACAGATTTCACACTCAAGATCAGTAGA GTGGAGGCTGAGGATCTGGGAGTTTATTACTGCTT TCAAGGTTCACATGTTCCTCGGACGTCCGGTGGAG GCACCAAGCTGGAAATCAAAGGCGGAGGTGGAAG CGGAGGGGGAGGATCTGGCGGCGGAGGAAGCGGA GGCCAGGTCCAGCTGCAGCAGTCTGGACCTGAGCT GGTGAAGCCTGGGGCTTCAGTGAGGATATCCTGCA AGGCTTCTGGCTACACCTTCACAAGTTACCATATA CATTGGGTGAAGCAGAGGCCTGGACAGGGACTTG AGTGGATTGGATGGATTTATCCTGGAAATGTTAAT ACTGAGTACAATGAGAAGTTCAAGGGCAAGGCCA CACTGACTGCAGACAAATCGTCCAGCACAGCCTAC ATGCACCTCAGCAGCCTGACCTCTGAGGACTCTGC GGTCTATTTCTGTGCCAGAGAGGAGATTACCTATG CTATGGACTACTGGGGTCAAGGAACCTCAGTCACC GTGTCCTCA (SEQ ID NO: 548) |
| QVQLVQSGAEVKKP GSSVKVSCK<u>ASGYTF TSYHIH</u>WVRQAPGQ GLEWMG<u>WIYPGNVN TEYNEKFKGK</u>ATITA DKSTSTAYMELSSLR SEDTAVYYCAR<u>EEIT YAMDY</u>WGQGTTVT VSSGGGGSGGGGSG GGGSGGEIVLTQSPG TLSLSPGERATLSC<u>RS SQSIVHSNGNTYLEW</u> YQQKPGQAPRLLIY<u>K VSNRF</u>SGIPDRFSGSG SGTDFTLTISRLEPED FAVYYC<u>FQGSHVPRT</u> FGGGTKVEIK (SEQ ID NO: 31) | CAGGTGCAGCTGGTGCAGTCTGGGGCTGAGGTGAA GAAGCCTGGGTCCTCAGTGAAGGTTTCCTGCAAGG CTTCTGGATACACCTTCACTAGCTATCATATACATT GGGTGCGCCAGGCCCCCGGACAAGGGCTTGAGTG GATGGGATGGATCTACCCTGGCAATGTTAACACAG AATATAATGAGAAGTTCAAGGGCAAAGCCACCATT ACCGCGGACAAATCCACGAGCACAGCCTACATGG AGCTGAGCAGCCTGAGATCTGAAGACACGGCTGTG TATTACTGTGCGAGGGAGGAAATTACCTACGCTAT GGACTACTGGGGCCAGGGAACCACAGTCACCGTGT CCTCAGGCGGAGGTGGAAGCGGAGGGGGAGGATC TGGCGGCGGAGGAAGCGGAGGCGAGATTGTATTG ACCCAGAGCCCAGGCACCCTGAGCCTCTCTCCAGG AGAGCGGGCCACCCTCAGTTGTAGATCCAGTCAGA GTATTGTACACAGTAATGGGAACACCTATTTGGAA TGGTATCAGCAGAAACCAGGTCAAGCCCCAAGATT GCTCATCTACAAAGTCTCTAACAGATTTAGTGGTA TTCCAGACAGGTTCAGCGGTTCCGGAAGTGGTACT GATTTCACCCTCACGATCTCCAGGCTCGAGCCAGA AGATTTCGCCGTTTATTACTGTTTTCAAGGTTCACA TGTGCCGCGCACATTCGGTGGGGGTACTAAAGTAG AAATCAAA (SEQ ID NO: 549) |
| QVQLVQSGAEVKKP GSSVKVSCK<u>ASGYTF TSYHIH</u>WVRQAPGQ GLEWMG<u>WIYPGNVN TEYNEKFKGK</u>ATITA DKSTSTAYMELSSLR SEDTAVYYCAR<u>EEIT YAMDY</u>WGQGTTVT VSSGGGGSGGGGSG GGGSGGDIVMTQTPL SLPVTPGEPASISC<u>RS SQSIVHSNGNTYLEW</u> YLQKPGQSPQLLIY<u>K VSNRF</u>SGVPDRFSGS GSGTDFTLKISRVEA EDVGVYYC<u>FQGSHV PRT</u>FGGGTKVEIK (SEQ ID NO: 32) | CAGGTGCAGCTGGTGCAGTCTGGGGCTGAGGTGAA GAAGCCTGGGTCCTCAGTGAAGGTTTCCTGCAAGG CTTCTGGATACACCTTCACTAGCTATCATATACATT GGGTGCGCCAGGCCCCCGGACAAGGGCTTGAGTG GATGGGATGGATCTACCCTGGCAATGTTAACACAG AATATAATGAGAAGTTCAAGGGCAAAGCCACCATT ACCGCGGACAAATCCACGAGCACAGCCTACATGG AGCTGAGCAGCCTGAGATCTGAAGACACGGCTGTG TATTACTGTGCGAGGGAGGAAATTACCTACGCTAT GGACTACTGGGGCCAGGGAACCACAGTCACCGTGT CCTCAGGCGGAGGTGGAAGCGGAGGGGGAGGATC TGGCGGCGGAGGAAGCGGAGGCGACATTGTAATG ACCCAGACCCCACTCAGCCTGCCCGTCACTCCAGG AGAGCCGGCCAGCATCAGTTGTAGATCCAGTCAGA GTATTGTACACAGTAATGGGAACACCTATTTGGAA TGGTATCTGCAGAAACCAGGTCAATCCCCACAATT GCTCATCTACAAAGTCTCTAACAGATTTAGTGGTG TACCAGACAGGTTCAGCGGTTCCGGAAGTGGTACT GATTTCACCCTCAAGATCTCCAGGGTCGAGCAGA AGATGTCGGCGTTTATTACTGTTTTCAAGGTTCACA TGTGCCGCGCACATTCGGTGGGGTACTAAAGTAG AAATCAAA (SEQ ID NO: 550) |
| EVQLVESGGGLVKP GGSLRLSCA<u>ASGYTF TSYHIH</u>WVRQAPGK GLEWVG<u>WIYPGNVN</u> | GAGGTGCAGCTGGTGGAGTCTGGGGGTGGGCTGGT GAAGCCTGGGGGCTCACTGAGGCTTTCCTGCGCGG CTTCTGGATACACCTTCACTAGCTATCATATACATT GGGTGCGCCAGGCCCCCGGAAAAGGGCTTGAGTG |

TABLE 5-continued

| HLA scFv binding domains | |
|---|---|
| TEYNEKFKGRFTISR<br>DDSKNTLYLQMNSL<br>KTEDTAVYYCAREEI<br>TYAMDYWGQGTTV<br>TVSSGGGGSGGGGS<br>GGGGSGGDIQMTQS<br>PSSLSASVGDRVTITC<br>RSSQSIVHSNGNTYL<br>EWYQQKPGKAPKLL<br>IYKVSNRFSGVPSRFS<br>GSGSGTDFTLTISSLQ<br>PEDFATYYCFQGSHV<br>PRTFGGGTKVEIK<br>(SEQ ID NO: 33) | GGTGGGATGGATCTACCCTGGCAATGTTAACACAG<br>AATATAATGAGAAGTTCAAGGGCAGATTCACCATT<br>AGCAGGGACGATTCCAAGAACACACTCTACCTGCA<br>GATGAACAGCCTGAAAACTGAAGACACGGCTGTGT<br>ATTACTGTGCGAGGGAGGAAATTACCTACGCTATG<br>GACTACTGGGGCCAGGGAACCACAGTCACCGTGTC<br>CTCAGGCGGAGGTGGAAGCGGAGGGGAGGATCT<br>GGCGGCGGAGGAAGCGGAGGCGACATTCAAATGA<br>CCCAGAGCCCATCCAGCCTGAGCGCATCTGTAGGT<br>GACCGGGTCACCATCACTTGTAGATCCAGTCAGAG<br>TATTGTACACAGTAATGGGAACACCTATTTGGAAT<br>GGTATCAGCAGAAACCAGGTAAAGCCCCAAAATT<br>GCTCATCTACAAAGTCTCTAACAGATTTAGTGGTG<br>TACCAAGCAGGTTCAGCGGTTCCGGAAGTGGTACT<br>GATTTCACCCTCACGATCTCCTCTCTCCAGCCAGAA<br>GATTTCGCCACTTATTACTGTTTTCAAGGTTCACAT<br>GTGCCGCGCACATTCGGTGGGGGTACTAAAGTAGA<br>AATCAAA (SEQ ID NO: 551) |
| QVQLVQSGAEVKKP<br>GSSVKVSCKASGYTF<br>TSYHIHWVRQAPGQ<br>GLEWIGWIYPGNVN<br>TEYNEKFKGKATITA<br>DESTNTAYMELSSLR<br>SEDTAVYYCAREEIT<br>YAMDYWGQGTLVT<br>VSSGGGGSGGGGSG<br>GGGSGGDIQMTQSPS<br>TLSASVGDRVTITCR<br>SSQSIVHSNGNTYLE<br>WYQQKPGKAPKLLI<br>YKVSNRFSGVPARFS<br>GSGSGTEFTLTISSLQ<br>PDDFATYYCFQGSH<br>VPRTFGQGTKVEVK<br>(SEQ ID NO: 34) | CAGGTGCAGCTGGTGCAGTCTGGGGCTGAGGTGAA<br>GAAGCCTGGGTCCTCAGTGAAGGTTTCCTGCAAGG<br>CTTCTGGATACACCTTCACTAGCTATCATATACATT<br>GGGTGCGCCAGGCCCCCGGACAAGGGCTTGAGTG<br>GATCGGATGGATCTACCCTGGCAATGTTAACACAG<br>AATATAATGAGAAGTTCAAGGGCAAAGCCACCATT<br>ACCGCGGACGAATCCACGAACACAGCCTACATGG<br>AGCTGAGCAGCCTGAGATCTGAAGACACGGCTGTG<br>TATTACTGTGCGAGGGAGGAAATTACCTACGCTAT<br>GGACTACTGGGGCCAGGGAACCCTGGTCACCGTGT<br>CCTCAGGCGGAGGTGGAAGCGGAGGGGGAGGATC<br>TGGCGGCGGAGGAAGCGGAGGCGACATTCAAATG<br>ACCCAGAGCCCATCCACCCTGAGCGCATCTGTAGG<br>TGACCGGGTCACCATCACTTGTAGATCCAGTCAGA<br>GTATTGTACACAGTAATGGGAACACCTATTTGGAA<br>TGGTATCAGCAGAAACCAGGTAAAGCCCCAAAATT<br>GCTCATCTACAAAGTCTCTAACAGATTTAGTGGTG<br>TACCAGCCAGGTTCAGCGGTTCCGGAAGTGGTACT<br>GAATTCACCCTCACGATCTCCTCTCTCCAGCCAGAT<br>GATTTCGCCACTTATTACTGTTTTCAAGGTTCACAT<br>GTGCCGCGCACATTCGGTCAGGGTACTAAAGTAGA<br>AGTCAAA (SEQ ID NO: 552) |
| QVQLVQSGAEVKKP<br>GSSVKVSCKASGYTF<br>TSYHMHWVRQAPG<br>QGLEWIGYIYPGNVN<br>TEYNEKFKGKATLT<br>ADKSTNTAYMELSSL<br>RSEDTAVYFCAREEI<br>TYAMDYWGQGTLV<br>TVSSGGGGSGGGGS<br>GGGGSGGDVQMTQS<br>PSTLSASVGDRVTITC<br>SSSQSIVHSNGNTYM<br>EWYQQKPGKAPKLL<br>IYKVSNRFSGVPDRF<br>SGSGSGTEFTLTISSL<br>QPDDFATYYCHQGS<br>HVPRTFGQGTKVEV<br>K (SEQ ID NO: 35) | CAGGTGCAGCTGGTGCAGTCTGGGGCTGAGGTGAA<br>GAAGCCTGGGTCCTCAGTGAAGGTTTCCTGCAAGG<br>CTTCTGGATACACCTTCACTAGCTATCATATGCATT<br>GGGTGCGCCAGGCCCCCGGACAAGGGCTTGAGTG<br>GATCGGATACATCTACCCTGGCAATGTTAACACAG<br>AATATAATGAGAAGTTCAAGGGCAAAGCCACCCTT<br>ACCGCGGACAAATCCACGAACACAGCCTACATGG<br>AGCTGAGCAGCCTGAGATCTGAAGACACGGCTGTG<br>TATTTCTGTGCGAGGGAGGAAATTACCTACGCTAT<br>GGACTACTGGGGCCAGGGAACCCTGGTCACCGTGT<br>CCTCAGGCGGAGGTGGAAGCGGAGGGGGAGGATC<br>TGGCGGCGGAGGAAGCGGAGGCGACGTTCAAATG<br>ACCCAGAGCCCATCCACCCTGAGCGCATCTGTAGG<br>TGACCGGGTCACCATCACTTGTAGCTCCAGTCAGA<br>GTATTGTACACAGTAATGGGAACACCTATATGGAA<br>TGGTATCAGCAGAAACCAGGTAAAGCCCCAAAATT<br>GCTCATCTACAAAGTCTCTAACAGATTTAGTGGTG<br>TACCAGACAGGTTCAGCGGTTCCGGAAGTGGTACT<br>GAATTCACCCTCACGATCTCCTCTCTCCAGCCAGAT<br>GATTTCGCCACTTATTACTGTCATCAAGGTTCACAT<br>GTGCCGCGCACATTCGGTCAGGGTACTAAAGTAGA<br>AGTCAAA (SEQ ID NO: 553) |
| QVQLQQSGPELVKP<br>GASVKMSCKASGYT<br>FTSYHIQWVKQRPG<br>QGLEWIGWIYPGDGS<br>TQYNEKFKGKTTLT<br>ADKSSSTAYMLLSSL<br>TSEDSAIYFCAREGT<br>YYAMDYWGQGTSV<br>TVSSGGGGSGGGGS<br>GGGGSGGDVLMTQT<br>PLSLPVSLGDQVSISC<br>RSSQSIVHSNGNTYL<br>EWYLQKPGQSPKLLI | CAGGTGCAGCTGCAGCAGTCTGGGCCTGAGCTGGT<br>GAAGCCTGGGGCCTCAGTGAAGATGTCCTGCAAGG<br>CTTCTGGATACACCTTCACTAGCTATCATATCCAGT<br>GGGTGAAGCAGAGGCCTGGACAAGGGCTTGAGTG<br>GATCGGATGGATCTACCCTGGCGATGGTAGTACAC<br>AGTATAATGAGAAGTTCAAGGGCAAAACCACCCTT<br>ACCGCGGACAAATCCTCCAGCACAGCCTACATGTT<br>GCTGAGCAGCCTGACCTCTGAAGACTCTGCTATCT<br>ATTTCTGTGCGAGGGAGGGGACCTACTACGCTATG<br>GACTACTGGGGCCAGGGAACCTCAGTCACCGTGTC<br>CTCAGGCGGAGGTGGAAGCGGAGGGGGAGGATCT<br>GGCGGCGGAGGAAGCGGAGGCGATGTTTTGATGA<br>CCCAGACTCCACTCTCCCTGCCTGTCTCTCTTGGAG |

TABLE 5-continued

HLA scFv binding domains

| | |
|---|---|
| YKVSNRFSGVPDRFS<br>GSGSGTDFTLKISRV<br>EAEDLGVYYCFQGS<br>HVPRTFGGGTKLEIK<br>(SEQ ID NO: 36) | ACCAAGTCTCCATCTCTTGTAGATCCAGTCAGAGT<br>ATTTGTACACAGTAATGGGAACACCTATTTAGAATG<br>GTATCTGCAGAAACCAGGTCAGTCTCCAAAGTTGC<br>TCATCTACAAAGTCTCTAACAGATTTAGTGGTGTA<br>CCAGACAGGTTCAGCGGTTCCGGAAGTGGTACTGA<br>TTTCACCCTCAAGATCTCGAGAGTGGAGGCTGAGG<br>ATCTGGGAGTTTATTACTGTTTTCAAGGTTCACATG<br>TGCCGCGCACATTCGGTGGAGGTACTAAACTGGAA<br>ATCAAA (SEQ ID NO: 554) |
| QLQLQESGPGLVKPS<br>ETLSLTCTVSGYTFTS<br>YHIQWIRQPPGKGLE<br>WIGWIYPGDGSTQY<br>NEKFKGRATISVDTS<br>KNQFSLNLDSVSAAD<br>TAIYYCAREGTYYA<br>MDYWGKGSTVTVSS<br>GGGGSGGGGSGGGG<br>SGGDIQMTQSPSSLS<br>ASVGDRVTITCRSSQ<br>SIVHSNGNTYLEWY<br>QQKPGKAPKLLIYKV<br>SNRFSGVPSRFSGSGS<br>GTDFTFTISSLQPEDI<br>ATYYCFQGSHVPRTF<br>GPGTKVDIK (SEQ ID<br>NO: 37) | CAGCTGCAGCTGCAGGAGTCTGGGCCCGGGCTGGT<br>GAAGCCTTCGGAAACGCTGAGCCTCACCTGCACGG<br>TTTCTGGATACACCTTCACCAGCTATCATATCCAGT<br>GGATCCGACAGCCCCCTGGAAAAGGGCTTGAGTGG<br>ATCGGATGGATCTACCCTGGCGATGGTTCAACACA<br>GTACAATGAGAAGTTCAAGGGCAGAGCCACGATT<br>AGCGTGGACACATCCAAGAACCAATTCTCCCTGAA<br>CCTGGACAGCGTGAGTGCTGCGGACACGGCCATTT<br>ATTACTGTGCGAGAGAGGGAACTTACTACGCTATG<br>GACTACTGGGGCAAAGGGAGCACGGTCACCGTGTC<br>CTCAGGCGGAGGTGGAAGCGGAGGGGGAGGATCT<br>GGCGGCGGAGGAAGCGGAGGCGACATCCAGATGA<br>CCCAGAGCCCAAGCTCCCTGAGTGCGTCCGTGGGC<br>GACCGCGTGACCATCACTTGCAGATCCTCTCAGTC<br>CATCGTGCACTCCAACGGCAACACGTACCTCGAGT<br>GGTACCAGCAGAAGCCCGGGAAGGCCCCGAAACT<br>GCTCATCTACAAGGTGAGCAACCGGTTCTCCGGCG<br>TCCCCAGCCGCTTCTCAGGGTCCGGCTCGGGGACG<br>GATTTCACCTTCACGATTAGCAGCTTGCAGCCCGA<br>AGACATCGCCACGTACTACTGCTTTCAGGGAAGTC<br>ACGTGCCGCGTACCTTCGGGCCGGGCACGAAAGTG<br>GATATTAAG (SEQ ID NO: 555) |
| EVQLVQSGAELKKP<br>GSSVKVSCKASGYTF<br>TSYHIQWVKQAPGQ<br>GLEWIGWIYPGDGST<br>QYNEKFKGKATLTV<br>DKSTNTAYMELSSLR<br>SEDTAVYYCAREGT<br>YYAMDYWGQGTLV<br>TVSSGGGGSGGGGS<br>GGGGSGGDIQMTQS<br>PSTLSASVGDRVTITC<br>RSSQSIVHSNGNTYL<br>EWYQQKPGKAPKLL<br>IYKVSNRFSGVPSRFS<br>GSGSGTDFTLTISSLQ<br>PDDFATYYCFQGSH<br>VPRTFGQGTKVEVK<br>(SEQ ID NO: 38) | GAGGTGCAGCTGGTGCAGTCTGGGGCCGAGCTGAA<br>GAAGCCTGGGTCCTCGGTGAAGGTGTCCTGCAAGG<br>CTTCTGGATACACCTTCACCAGCTATCATATCCAGT<br>GGGTAAAACAGGCCCCTGGACAAGGGCTTGAGTG<br>GATCGGATGGATCTACCCTGGCGATGGTTCAACAC<br>AGTACAATGAGAAGTTCAAGGGCAAAGCCACGCTT<br>ACCGTGGACAAATCCACGAACACACGCTACATGGA<br>GCTGAGCAGCCTGAGATCTGAGGACACGGCCGTAT<br>ATTACTGTGCGAGAGAGGGAACTTACTACGCTATG<br>GACTACTGGGGCCAAGGGACCCTGGTCACCGTGTC<br>CTCAGGCGGAGGTGGAAGCGGAGGGGGAGGATCT<br>GGCGGCGGAGGAAGCGGAGGCGACATCCAGATGA<br>CCCAGAGCCCATCCACCCTGAGTGCGTCCGTGGGC<br>GACCGCGTGACCATCACTTGCAGATCCTCTCAGTC<br>CATCGTGCACTCCAACGGCAACACGTACCTCGAGT<br>GGTACCAGCAGAAGCCCGGGAAGGCCCCGAAACT<br>GCTCATCTACAAGGTGAGCAACCGGTTCTCCGGCG<br>TCCCCAGCCGCTTCTCAGGGTCCGGCTCGGGGACG<br>GATTTCACCCTCACGATTAGCAGCTTGCAGCCCGA<br>TGACTTCGCCACGTACTACTGCTTTCAGGGAAGTC<br>ACGTGCCGCGTACCTTCGGGCAGGGCACGAAAGTG<br>GAAGTTAAG (SEQ ID NO: 556) |
| QVQLVQSGAEVKKP<br>GSSVKVSCKASGYTF<br>TSYHIQWVRQAPGQ<br>GLEWMGWIYPGDGS<br>TQYNEKFKGRVTITA<br>DKSTSTAYMELSSLR<br>SEDTAVYYCAREGT<br>YYAMDYWGQGTTV<br>TVSSGGGGSGGGGS<br>GGGGSGGEIVLTQSP<br>GTLSLSPGERATLSC<br>RSSQSIVHSNGNTYL<br>EWYQQKPGQAPRLLI<br>YKVSNRFSGIPDRFS<br>GSGSGTDFTLTISRLE<br>PEDFAVYYCFQGSH<br>VPRTFGGGTKVEIK<br>(SEQ ID NO: 39) | CAGGTGCAGCTGGTGCAGTCTGGGGCCGAGGTGAA<br>GAAGCCTGGGTCCTCGGTGAAGGTGTCCTGCAAGG<br>CTTCTGGATACACCTTCACCAGCTATCATATCCAGT<br>GGGTACGACAGGCCCCTGGACAAGGGCTTGAGTG<br>GATGGGATGGATCTACCCTGGCGATGGTTCAACAC<br>AGTACAATGAGAAGTTCAAGGGCAGAGTCACGATT<br>ACCGCGGACAAATCCACGAGCACAGCCTACATGG<br>AGCTGAGCAGCCTGAGATCTGAGGACACGGCCGTA<br>TATTACTGTGCGAGAGAGGGAACTTACTACGCTAT<br>GGACTACTGGGGCCAAGGGACCACGGTCACCGTGT<br>CCTCAGGCGGAGGTGGAAGCGGAGGGGGAGGATC<br>TGGCGGCGGAGGAAGCGGAGGCGAGATCGTCCTG<br>ACCCAGAGCCCAGGGACCCTGAGTTTGTCCCCGGG<br>CGAGCGCGCGACCCTCAGTTGCAGATCCTCTCAGT<br>CCATCGTGCACTCCAACGGCAACACGTACCTCGAG<br>TGGTACCAGCAGAAGCCCGGGCAGGCCCCGCGACT<br>GCTCATCTACAAGGTGAGCAACCGGTTCTCCGGCA<br>TCCCCGACCGCTTCTCAGGGTCCGGCTCGGGGACG<br>GATTTCACCCTCACGATTAGCCGCTTGGAGCCCGA<br>AGACTTCGCCGTGTACTACTGCTTTCAGGGAAGTC<br>ACGTGCCGCGTACCTTCGGGGGGGCACGAAAGTG<br>GAAATTAAG (SEQ ID NO: 557) |

TABLE 5-continued

HLA scFv binding domains

| | |
|---|---|
| QVTLKQSGAEVKKP<br>GSSVKVSCTA<u>SGYTF</u><br><u>TSYHVS</u>WVRQAPGQ<br>GLEWLG<u>RIYPGDGST</u><br><u>QYNEKFKG</u>KVTITAD<br>KSMDTSFMELTSLTS<br>EDTAVYYCAR<u>EGTY</u><br><u>YAMDL</u>WGQGTLVT<br>VSSGGGGSGGGGSG<br>GGGSGGEIVLTQSPG<br>TLSLSPGERATLSC<u>RS</u><br><u>SQSIVHSNGNTYLAW</u><br>YQQKPGQAPRLLIS<u>K</u><br><u>VSNRFSGVPDR</u>FSGS<br>GSGTDFTLTISRLEPE<br>DFAVYYC<u>QQGSHVP</u><br><u>RT</u>FGGGTKVEIK<br>(SEQ ID NO: 40) | CAGGTGACCCTGAAGCAGTCTGGGGCCGAGGTGA<br>AGAAGCCTGGGTCCTCGGTGAAGGTGTCCTGCACG<br>GCTTCTGGATACACCTTCACCAGCTATCATGTCAGC<br>TGGGTACGACAGGCCCCTGGACAAGGGCTTGAGTG<br>GTTGGGAAGGATCTACCCTGGCGATGGTTCAACAC<br>AGTACAATGAGAAGTTCAAGGGCAAAGTCACGATT<br>ACCGCGGACAAATCCATGGACACATCCTTCATGGA<br>GCTGACCAGCCTGACATCTGAGGACACGGCCGTAT<br>ATTACTGTGCGAGAGAGGGAACTTACTACGCTATG<br>GACCTCTGGGGCCAAGGGACCCTGGTCACCGTCTC<br>CTCAGGCGGAGGTGGAAGCGGAGGGGGAGGATCT<br>GGCGGCGGAGGAAGCGGAGGCGAGATCGTCCTGA<br>CCCAGAGCCCAGGGACCCTGAGTTTGTCCCCGGGC<br>GAGCGCGCGACCCTCAGTTGCAGATCCTCTCAGTC<br>CATCGTGCACTCCAACGGCAACACGTACCTCGCGT<br>GGTACCAGCAGAAGCCCGGGCAGGCCCCGCGACT<br>GCTCATCTCCAAGGTGAGCAACCGGTTCTCCGGCG<br>TCCCCGACCGCTTCTCAGGGTCCGGCTCGGGGACG<br>GATTTCACCCTCACGATTAGCCGCTTGGAGCCCGA<br>AGACTTCGCCGTGTACTACTGCCAACAGGGAAGTC<br>ACGTGCCGCGTACCTTCGGGGGGGCACGAAAGTG<br>GAAATTAAG (SEQ ID NO: 558) |
| QVQLVQSGAEVKKP<br>GASVKVSCKA<u>SGYT</u><br><u>FTSYHMH</u>WVRQAPG<br>QRLEWMG<u>WIYPGDG</u><br><u>STQYNEKFKG</u>KVTIT<br>RDTSASTAYMELSSL<br>RSEDTAVYYCAR<u>EG</u><br><u>TYYAMDY</u>WGQGTL<br>VTVSSGGGGSGGGG<br>SGGGGSGGDIVMTQ<br>TPLSLPVTPGEPASIS<br>C<u>RSSQSIVHSNGNTY</u><br><u>L</u>DWYLQKPGQSPQL<br>LIY<u>KVSNRFSGVPDR</u><br>FSGSGSGTDFTLKISR<br>VEAEDVGVYYC<u>MQ</u><br><u>GSHVPRT</u>FGGGTKVE<br>IK (SEQ ID NO: 41) | CAGGTGCAGCTGGTGCAGTCTGGGGCCGAGGTGAA<br>GAAGCCTGGGGCCTCGGTGAAGGTGTCCTGCAAGG<br>CTTCTGGATACACCTTCACCAGCTATCATATGCACT<br>GGGTACGACAGGCCCCTGGACAAAGGCTTGAGTG<br>GATGGGATGGATCTACCCTGGCGATGGTTCAACAC<br>AGTACAATGAGAAGTTCAAGGGCAAAGTCACGATT<br>ACCCGGGACACATCCGCGAGCACAGCCTACATGGA<br>GCTGAGCAGCCTGAGATCTGAGGACACGGCCGTAT<br>ATTACTGTGCGAGAGAGGGAACTTACTACGCTATG<br>GACTACTGGGGCCAAGGGACCCTGGTCACCGTGTC<br>CTCAGGCGGAGGTGGAAGCGGAGGGGGAGGATCT<br>GGCGGCGGAGGAAGCGGAGGCGACATCGTCATGA<br>CCCAGACCCCACTGTCCCTGCCTGTGACCCCGGGC<br>GAGCCCGCGAGCATCAGTTGCAGATCCTCTCAGTC<br>CATCGTGCACTCCAACGGCAACACGTACCTCGACT<br>GGTACCTGCAGAAGCCCGGGCAGTCCCCGCAACTG<br>CTCATCTACAAGGTGAGCAACCGGTTCTCCGGCGT<br>CCCCGACCGCTTCTCAGGGTCCGGCTCGGGGACGG<br>ATTTCACCCTCAAGATTAGCCGCGTGGAGGCCGAA<br>GACGTCGGCGTGTACTACTGCATGCAGGGAAGTCA<br>CGTGCCGCGTACCTTCGGGGGGGCACGAAAGTGG<br>AAATTAAG (SEQ ID NO: 559) |

HLA-B*07 antigen binding domains

| | |
|---|---|
| 1.10_scFv | QVQLQESGPGLVKPSQTLSLTCTVSGYSITSGYSWHW<br>IRQPPGKGLEWIGYIHFSGSTHYHPSLKSRVTISVDTS<br>KNQFSLKLSSVTAADTAVYYCARGGVVSHYAMDCW<br>GQGTTVTVSSGGGGSGGGGSGGGGSGGDIQMTQSPS<br>SLSASVGDRVTITCRASENIYSNLAWYQQKPGKAPKL<br>LIYAATYLPDGVPSRFSGSGSGTDFTLTISSLQPEDFA<br>TYYCQHFWVTPYTFGGGTKVEIK (SEQ ID NO: 560) |
| 1.9_scFv | EVQLVESGGGLVKPGGSLRLSCAASGYSITSGYSWH<br>WVRQAPGKGLEWVSYIHFSGSTHYHPSLKSRFTISRD<br>NAKNSLYLQMNSLRAEDTAVYYCARGGVVSHYAM<br>DCWGQGTTVTVSSGGGGSGGGGSGGGGSGGDIQMT<br>QSPSSVSASVGDRVTITCRASENIYSNLAWYQQKPGK<br>APKLLIYAATYLPDGVPSRFSGSGSGTDFTLTISSLQP<br>EDFATYYCQHFWVTPYTFGGGTKVEIK (SEQ ID NO:<br>561) |
| 1.8_scFv | EVQLVESGGGLVKPGGSLRLSCAASGYSITSGYSWH<br>WVRQAPGKGLEWVGYIHFSGSTHYHPSLKSRFTISRD<br>DSKNTLYLQMNSLKTEDTAVYYCARGGVVSHYAMD<br>CWGQGTTVTVSSGGGGSGGGGSGGGGSGGEIVLTQS<br>PATLSLSPGERATLSCRASENIYSNLAWYQQKPGQAP<br>RLLIYAATYLPDGIPARFSGSGSGTDFTLTISSLEPEDF<br>AVYYCQHFWVTPYTFGGGTKVEIK (SEQ ID NO: 562) |
| 1.7_scFv | QVQLQQSGPGLVKPSQTLSLTCAISGYSITSGYSWHW<br>IRQSPSRGLEWLGYIHFSGSTHYHPSLKSRITINPDTSK<br>NQFSLQLNSVTPEDTAVYYCARGGVVSHYAMDCWG<br>QGTTVTVSSGGGGSGGGGSGGGGSGGEIVLTQSPAT |

TABLE 5-continued

HLA scFv binding domains

|  |  |
|---|---|
|  | LSLSPGERATLSCRASENIYSNLAWYQQKPGQAPRLL<br>IYAATYLPDGIPARFSGSGSGTDFTLTISRLEPEDFAVY<br>YCQHFWVTPYTFGGGTKVEIK (SEQ ID NO: 563) |
| 1.6_scFv | EVQLVESGGGLVKPGGSLRLSCAASGYSITSGYSWH<br>WVRQAPGKGLEWVGYIHFSGSTHYHPSLKSRFTISRD<br>DSKNTLYLQMNSLKTEDTAVYYCARGGVVSHYAMD<br>CWGQGTTVTVSSGGGGSGGGGSGGGGSGGDIQMTQ<br>SPSSVSASVGDRVTITCRASENIYSNLAWYQQKPGKA<br>PKLLIYAATYLPDGVPSRFSGSGSGTDFTLTISSLQPE<br>DFATYYCQHFWVTPYTFGGGTKVEIK (SEQ ID NO:<br>564) |
| 1.5_scFv | EVQLVESGGGLVQPGGSLRLSCAASGYSITSGYSWH<br>WVRQAPGKGLEWVSYIHFSGSTHYHPSLKSRFTISRD<br>NSKNTLYLQMNSLRAEDTAVYYCARGGVVSHYAM<br>DCWGQGTTVTVSSGGGGSGGGGSGGGGSGGDIQMT<br>QSPSSLSASVGDRVTITCRASENIYSNLAWYQQKPGK<br>APKLLIYAATYLPDGVPSRFSGSGSGTDFTLTISSLQP<br>EDFATYYCQHFWVTPYTFGGGTKVEIK (SEQ ID NO:<br>565) |
| 1.4_scFv | EVQLVESGGGLVKPGGSLRLSCAASGYSITSGYSWH<br>WVRQAPGKGLEWVGYIHFSGSTHYHPSLKSRFTISRD<br>DSKNTLYLQMNSLKTEDTAVYYCARGGVVSHYAMD<br>CWGQGTTVTVSSGGGGSGGGGSGGGGSGGDIQMTQ<br>SPSSLSASVGDRVTITCRASENIYSNLAWYQQKPGKA<br>PKLLIYAATYLPDGVPSRFSGSGSGTDFTLTISSLQPE<br>DFATYYCQHFWVTPYTFGGGTKVEIK (SEQ ID NO:<br>566) |
| 1.3_scFv | QVQLQQWGAGLLKPSETLSLTCAVYGYSITSGYSWH<br>WIRQPPGKGLEWIGYIHFSGSTHYHPSLKSRVTISVDT<br>SKNQFSLKLSSVTAADTAVYYCARGGVVSHYAMDC<br>WGQGTTVTVSSGGGGSGGGGSGGGGSGGDIQMTQS<br>PSSLSASVGDRVTITCRASENIYSNLAWYQQKPGKAP<br>KLLIYAATYLPDGVPSRFSGSGSGTDFTLTISSLQPED<br>FATYYCQHFWVTPYTFGGGTKVEIK (SEQ ID NO:<br>567) |
| 1.2_scFv | QVQLQESGPGLVKPSQTLSLTCTVSGYSITSGYSWHW<br>IRQHPGKGLEWIGYIHFSGSTHYHPSLKSRVTISVDTS<br>KNQFSLKLSSVTAADTAVYYCARGGVVSHYAMDCW<br>GQGTTVTVSSGGGGSGGGGSGGGGSGGDIQMTQSPS<br>SLSASVGDRVTITCRASENIYSNLAWYQQKPGKAPKL<br>LIYAATYLPDGVPSRFSGSGSGTDFTLTISSLQPEDFA<br>TYYCQHFWVTPYTFGGGTKVEIK (SEQ ID NO: 568) |
| 1.1_scFv | QVQLQQSGPGLVKPSQTLSLTCAISGYSITSGYSWHW<br>IRQSPSRGLEWLGYIHFSGSTHYHPSLKSRITINPDTSK<br>NQFSLQLNSVTPEDTAVYYCARGGVVSHYAMDCWG<br>QGTTVTVSSGGGGSGGGGSGGGGSGGDIQMTQSPSS<br>LSASVGDRVTITCRASENIYSNLAWYQQKPGKAPKLL<br>IYAATYLPDGVPSRFSGSGSGTDFTLTISSLQPEDFAT<br>YYCQHFWVTPYTFGGGTKVEIK (SEQ ID NO: 569) |

HLA-A*11 antigen binding domains

| | |
|---|---|
| QVQLQESGPGLVKPS<br>QTLSLTCTVSGGSISS<br>GGYYWSWIRQPPGK<br>GLEWIGYIYYSGSTY<br>YNPSLKSRVTISVDTS<br>KNQFSLKLSSVTAAD<br>TAVYYCARHYYYS<br>MDVWGKGTTVTVSS<br>GGGGSGGGGSGGGG<br>SGGDIQMTQSPSSLS<br>ASVGDRVTITCRASQ<br>SISSYLNWYQQKPGK<br>APKLLIYAASSLQSG<br>VPSRFSGSGSGTDFT<br>LTISSLQPEDFATYYC<br>QQSYSTPLTFGGGTK<br>VEIK (SEQ ID NO:<br>114) | CAGGTGCAGCTGCAGGAAAGCGGCCCTGGCCTGGT<br>GAAACCCAGCCAGACCCTGAGCCTGACCTGCACAG<br>TGTCCGGCGGCTCGATCAGCAGCAGCGGCTACTAC<br>TGGTCCTGGATCAGACAGCCCCCTGGCAAGGGCCT<br>GGAATGGATCGGCTACATCTACTACAGCGGCAGCA<br>CCTACTACAACCCCAGCCTGAAGTCCAGAGTGACC<br>ATCAGCGTGGACACCAGCAAGAACCAGTTCAGCCT<br>GAAGCTGAGCAGCGTGACAGCCGCCGACACCGCT<br>GTGTATTACTGTGCGAGACACTACTACTACTACTCC<br>ATGGACGTCTGGGGCAAAGGGACCACGGTCACCGT<br>GTCCTCAGGCGGAGGTGGAAGCGGAGGGGGAGGA<br>TCTGGCGGCGGAGGAAGCGGAGGCGACATCCAGA<br>TGACCCAGTCTCCATCCTCCCTGTCTGCATCTGTAG<br>GAGACAGAGTCACCATCACTTGCCGGGCAAGTCAG<br>AGCATTAGCAGCTATTTAAATTGGTATCAGCAGAA<br>ACCAGGGAAAGCCCCTAAGCTCCTGATCTATGCTG<br>CATCCAGTTTGCAAAGTGGGGTCCCATCAAGGTTC<br>AGTGGCAGTGGATCTGGGACAGATTTCACTCTCAC<br>CATCAGCAGTCTGCAACCTGAAGATTTTGCAACTT |

TABLE 5-continued

| HLA scFv binding domains | |
|---|---|
| | ACTACTGTCAACAGAGTTACAGTACCCTCTCACTT<br>TCGGCGGCGGAACAAAGGTGGAGATCAAG (SEQ ID<br>NO: 123) |
| QITLKESGPTLVKPT<br>QTLTLTCTFSGFSLS<u>T</u><br><u>SGVGVG</u>WIRQPPGK<br>ALEWL<u>ALIYWNDDK</u><br><u>RYSPSLKS</u>RLTITKDT<br>SKNQVVLTMTNMDP<br>VDTATYYCAH<u>RHMR</u><br><u>LSCFDY</u>WGQGTLVT<br>VSSGGGGSGGGGSG<br>GGGSGGDIQMTQSPS<br>SLSASVGDRVTITC<u>R</u><br><u>ASQSISSYLN</u>WYQQK<br>PGKAPKLLIY<u>AASSL</u><br><u>Q</u>SGVPSRFSGSGSGT<br>DFTLTISSLQPEDFAT<br>YYC<u>QQSYSTPLT</u>FGG<br>GTKVEIK (SEQ ID<br>NO: 115) | CAGATCACCCTGAAAGAGTCCGGCCCCACCCTGGT<br>GAAACCCACCCAGACCCTGACCCTGACATGCACCT<br>TCAGCGGCTTCAGCCTGAGCACCTCTGGCGTGGGC<br>GTGGGCTGGATCAGACAGCCTCCCGGCAAGGCCCT<br>GGAATGGCTGGCCCTGATCTACTGGAACGACGACA<br>AGCGGTACAGCCCCAGCCTGAAGTCCCGGCTGACC<br>ATCACCAAGGACACCTCGAAGAACCAGGTGGTGCT<br>GACCATGACAAACATGGACCCCGTGGACACCGCCA<br>CATATTACTGTGCACACAGACACATGCGTTTAAGC<br>TGTTTTGACTACTGGGGCCAGGGAACCCTGGTCAC<br>CGTGTCCTCAGGCGGAGGTGGAAGCGGAGGGGGA<br>GGATCTGGCGGCGGAGGAAGCGGAGGCGACATCC<br>AGATGACCCAGTCTCCATCCTCCCTGTCTGCATCTG<br>TAGGAGACAGAGTCACCATCACTTGCCGGGCAAGT<br>CAGAGCATTAGCAGCTATTTAAATTGGTATCAGCA<br>GAAACCAGGGAAAGCCCCTAAGCTCCTGATCTATG<br>CTGCATCCAGTTTGCAAAGTGGGGTCCCATCAAGG<br>TTCAGTGGCAGTGGATCTGGGACAGATTTCACTCT<br>CACCATCAGCAGTCTGCAACCTGAAGATTTTGCAA<br>CTTACTACTGTCAACAGAGTTACAGTACCCCTCTCA<br>CTTTCGGCGGCGGAACAAAGGTGGAGATCAAG<br>(SEQ ID NO: 124) |
| QVQLVQSGAEVKKP<br>GASVKVSCKASGYT<br>FT<u>SYAMH</u>WVRQAPG<br>QRLEWMG<u>WINAGN</u><br><u>GNTKYSQKFQ</u>GRVTI<br>TRDTSASTAYMELSS<br>LRSEDTAVYYCAR<u>E</u><br><u>GNGANPDAFDI</u>WGQ<br>GTMVTVSSGGGGSG<br>GGGSGGGGSGGDIQ<br>MTQSPSSLSASVGDR<br>VTITC<u>RASQSISSYLN</u><br>WYQQKPGKAPKLLI<br>Y<u>AASSLQ</u>GVPSRFS<br>GSGSGTDFTLTISSLQ<br>PEDFATYYC<u>QQSYST</u><br><u>PLT</u>FGGGTKVEIK<br>(SEQ ID NO: 116) | CAGGTGCAGCTGGTGCAGTCTGGCGCCGAAGTGAA<br>GAAACCTGGCGCCTCCGTGAAGGTGTCCTGCAAGG<br>CCAGCGGCTACACCTTCACCAGCTACGCCATGCAC<br>TGGGTTCGACAGGCCCCTGGCCAGAGACTGGAATG<br>GATGGGCTGGATCAACGCCGGCAACGGCAACACC<br>AAGTACAGCCAGAAATTCCAGGGCAGAGTGACCA<br>TCACCCGGGACACCAGCGCCAGCACCGCCTACATG<br>GAACTGAGCAGCCTGCGGAGCGAGGACACCGCTG<br>TGTATTACTGTGCGAGAGAAGGAAATGGTGCCAAC<br>CCTGATGCTTTTGATATCTGGGGCCAAGGGACAAT<br>GGTCACCGTGTCCTCAGGCGGAGGTGGAAGCGGA<br>GGGGGAGGATCTGGCGGCGGAGGAAGCGGAGGCG<br>ACATCCAGATGACCCAGTCTCCATCCTCCCTGTCTG<br>CATCTGTAGGAGACAGAGTCACCATCACTTGCCGG<br>GCAAGTCAGAGCATTAGCAGCTATTTAAATTGGTA<br>TCAGCAGAAACCAGGGAAAGCCCCTAAGCTCCTGA<br>TCTATGCTGCATCCAGTTTGCAAAGTGGGGTCCCA<br>TCAAGGTTCAGTGGCAGTGGATCTGGGACAGATTT<br>CACTCTCACCATCAGCAGTCTGCAACCTGAAGATT<br>TTGCAACTTACTACTGTCAACAGAGTTACAGTACC<br>CCTCTCACTTTCGGCGGCGGAACAAAGGTGGAGAT<br>CAAG(SEQ ID NO: 125) |
| EVQLVESGGGLVQP<br>GGSLRLSCAASGFTF<br>S<u>SYDMH</u>WVRQATG<br>KGLEWVS<u>AIGTAGD</u><br><u>TYYPGSVKG</u>RFTISR<br>ENAKNSLYLQMNSL<br>RAGDTAVYYCAR<u>DL</u><br><u>PGSYWYFDL</u>WGRGT<br>LVTVSSGGGGSGGG<br>GSGGGGSGGDIQMT<br>QSPSSLSASVGDRVTI<br>TC<u>RASQSISSYLN</u>WY<br>QQKPGKAPKLLIY<u>AA</u><br><u>SSLQ</u>SGVPSRFSGSGS<br>GTDFTLTISSLQPEDF<br>ATYYC<u>QQSYSTPLT</u>F<br>GGGTKVEIK (SEQ ID<br>NO: 117) | GAAGTGCAGCTGGTGGAAAGCGGCGGAGGCCTGG<br>TGCAGCCTGGCGGCAGCCTGAGACTGTCTTGCGCC<br>GCCAGCGGCTTCACCTTCAGCAGCTACGACATGCA<br>CTGGGTCCGCCAGGCCACCGGCAAGGGACTGGAAT<br>GGGTGTCCGCCATCGGCACAGCCGGCGACACTTAC<br>TACCCCGGCAGCGTGAAGGGCCGGTTCACCATCAG<br>CAGAGAGAACGCCAAGAACAGCCTGTACCTGCAG<br>ATGAACAGCCTTCGAGCCGGCGATACCGCCGTGTA<br>TTACTGTGCAAGAGATCTCCCTGGTAGCTACTGGT<br>ACTTCGATCTCTGGGGCCGTGGCACCCTGGTCACT<br>GTGTCCTCAGGCGGAGGTGGAAGCGGAGGGGGAG<br>GATCTGGCGGCGGAGGAAGCGGAGGCGACATCCA<br>GATGACCCAGTCTCCATCCTCCCTGTCTGCATCTGT<br>AGGAGACAGAGTCACCATCACTTGCCGGGCAAGTC<br>AGAGCATTAGCAGCTATTTAAATTGGTATCAGCAG<br>AAACCAGGGAAAGCCCCTAAGCTCCTGATCTATGC<br>TGCATCCAGTTTGCAAAGTGGGGTCCCATCAAGGT<br>TCAGTGGCAGTGGATCTGGGACAGATTTCACTCTC<br>ACCATCAGCAGTCTGCAACCTGAAGATTTTGCAAC<br>TTACTACTGTCAACAGAGTTACAGTACCCCTCTCAC<br>TTTCGGCGGCGGAACAAAGGTGGAGATCAAG (SEQ<br>ID NO: 126) |
| QVQLQESGPGLVKPS<br>QTLSLTCTVSGGSIS<u>S</u><br><u>GGYYWS</u>WIRQPPGK<br>GLEWIG<u>YIYYSGSTY</u><br><u>YNPSLKS</u>RVTISVDTS | CAGGTGCAGCTGCAGGAAAGCGGCCCTGGCCTGGT<br>GAAACCCAGCCAGACCCTGAGCCTGACCTGCACAG<br>TGTCCGGCGGCTCGATCAGCAGCGGCGGCTACTAC<br>TGGTCCTGGATCAGACAGCCCCCTGGCAAGGGCCT<br>GGAATGGATCGGCTACATCTACTACAGCGGCAGCA |

TABLE 5-continued

| HLA scFv binding domains | |
|---|---|
| KNQFSLKLSSVTAAD TAVYYCARHYYYY LDVWGKGTTVTVSS GGGGSGGGGSGGGG SGGDIQMTQSPSSLS ASVGDRVTITCRASQ SISSYLNWYQQKPGK APKLLIYAASSLQSG VPSRFSGSGSGTDFT LTISSLQPEDFATYYC QQSYSTPLTFGGGTK VEIK (SEQ ID NO: 118) | CCTACTACAACCCCAGCCTGAAGTCCAGAGTGACC ATCAGCGTGGACACCAGCAAGAACCAGTTCAGCCT GAAGCTGAGCAGCGTGACAGCCGCCGACACCGCT GTGTATTACTGTGCGAGACACTACTACTACTACTA CCTGGACGTCTGGGGCAAAGGGACCACGGTCACCG TGTCCTCAGGCGGAGGTGGAAGCGGAGGCGGAGG ATCTGGCGGCGGAGGAAGCGGAGGCGACATCCAG ATGACCCAGTCTCCATCCTCCCTGTCTGCATCTGTA GGAGACAGAGTCACCATCACTTGCCGGGCAAGTCA GAGCATTAGCAGCTATTTAAATTGGTATCAGCAGA AACCAGGGAAAGCCCCTAAGCTCCTGATCTATGCT GCATCCAGTTTGCAAAGTGGGGTCCCATCAAGGTT CAGTGGCAGTGGATCTGGGACAGATTTCACTCTCA CCATCAGCAGTCTGCAACCTGAAGATTTTGCAACT TACTACTGTCAACAGAGTTACAGTACCCCTCTCACT TTCGGCGGCGGAACAAAGGTGGAGATCAAG (SEQ ID NO: 127) |
| EVQLVESGGGLVQP GGSLRLSCAASGFTF SSYWMHWVRQAPG KGLVWVSRINSDGSS TSYADSVKGRFTISR DNAKNTLYLQMNSL RAEDTAVYYCLGV LLYNWFDPWGQGTL VTVSSGGGGSGGGG SGGGGSGGDIQMTQ SPSSLSASVGDRVTIT CRASQSISSYLNWYQ QKPGKAPKLLIYAAS SLQSGVPSRFSGSGS GTDFTLTISSLQPEDF ATYYCQQSYSTPLTF GGGTKVEIK (SEQ ID NO: 119) | GAAGTGCAGCTGGTGGAAAGCGGCGGAGGCCTGG TGCAGCCTGGCGGCAGCCTGAGACTGTCTTGCGCC GCCAGCGGCTTCACCTTCAGCAGCTACTGGATGCA CTGGGTCCGCCAGGCCCCTGGCAAGGGACTGGTCT GGGTGTCTCGAATCAACAGCGACGGCAGCAGCACC AGCTACGCCGACAGCGTGAAGGGCCGGTTCACCAT CAGCCGGGACAACGCCAAGAACACCCTGTACCTGC AGATGAACAGCCTGCGGGCCGAGGACACCGCCGT GTATTACTGTTGTTTGGGTGTTTTATTATACAACTG GTTCGACCCCTGGGGCCAGGGAACCCTGGTCACCG TGTCCTCAGGCGGAGGTGGAAGCGGAGGGGGAGG ATCTGGCGGCGGAGGAAGCGGAGGCGACATCCAG ATGACCCAGTCTCCATCCTCCCTGTCTGCATCTGTA GGAGACAGAGTCACCATCACTTGCCGGGCAAGTCA GAGCATTAGCAGCTATTTAAATTGGTATCAGCAGA AACCAGGGAAAGCCCCTAAGCTCCTGATCTATGCT GCATCCAGTTTGCAAAGTGGGGTCCCATCAAGGTT CAGTGGCAGTGGATCTGGGACAGATTTCACTCTCA CCATCAGCAGTCTGCAACCTGAAGATTTTGCAACT TACTACTGTCAACAGAGTTACAGTACCCCTCTCACT TTCGGCGGCGGAACAAAGGTGGAGATCAAG (SEQ ID NO: 128) |
| QVQLQESGPGLVKPS QTLSLTCTVSGGSISS GGYYWSWIRQPPGK GLEWIGYIYYSGSTY YNPSLKSRVTISVDTS KNQFSLKLSSVTAAD TAVYYCARHYYYY MDVWGKGTTVTVSS GGGGSGGGGSGGGG SGGDIQMTQSPSSLS ASVGDRVTITCRASQ SISSYLNWYQQKPGK APKLLIYAASSLQSG VPSRFSGSGSGTDFT LTISSLQPEDFATYYC QQSYSTPLTFGGGTK VEIK (SEQ ID NO: 120) | CAGGTGCAGCTGCAGGAAAGCGGCCCTGGCCTGGT GAAACCCAGCCAGACCCTGAGCCTGACCTGCACAG TGTCCGGCGGCTCGATCAGCAGCGGCGGCTACTAC TGGTCCTGGATCAGACAGCCCCCTGGCAAGGGCCT GGAATGGATCGGCTACATCTACTACAGCGGCAGCA CCTACTACAACCCCAGCCTGAAGTCCAGAGTGACC ATCAGCGTGGACACCAGCAAGAACCAGTTCAGCCT GAAGCTGAGCAGCGTGACAGCCGCCGACACCGCT GTGTATTACTGTGCGAGACACTACTACTACTACAT GGACGTCTGGGGCAAAGGGACCACGGTCACCGTGT CCTCAGGCGGAGGTGGAAGCGGAGGCGGAGGATC TGGCGGCGGAGGAAGCGGAGGCGACATCCAGATG ACCCAGTCTCCATCCTCCCTGTCTGCATCTGTAGGA GACAGAGTCACCATCACTTGCCGGGCAAGTCAGAG CATTAGCAGCTATTTAAATTGGTATCAGCAGAAAC CAGGGAAAGCCCCTAAGCTCCTGATCTATGCTGCA TCCAGTTTGCAAAGTGGGGTCCCATCAAGGTTCAG TGGCAGTGGATCTGGGACAGATTTCACTCTCACCA TCAGCAGTCTGCAACCTGAAGATTTTGCAACTTAC TACTGTCAACAGAGTTACAGTACCCCTCTCACTTTC GGCGGCGGAACAAAGGTGGAGATCAAG (SEQ ID NO: 129) |
| QITLKESGPTLVKPT QTLTLTCTFSGFSLST SGVGVGWIRQPPGK ALEWLALIYWNDDK RYSPSLKSRLTITKDT SKNQVVLTMTNMDP VDTATYYCAHKTTS FYFDYWGQGTLVTV SSGGGGSGGGGSGG GGSGGDIQMTQSPSS LSASVGDRVTITCRA SQSISSYLNWYQQKP GKAPKLLIYAASSLQ SGVPSRFSGSGSGTD | CAGATCACCCTGAAAGAGTCCGGCCCCACCCTGGT GAAACCCACCCAGACCCTGACCCTGACATGCACCT TCAGCGGCTTCAGCCTGAGCACCTCTGGCGTGGGC GTGGGCTGGATCAGACAGCCTCCCGGCAAGGCCCT GGAATGGCTGGCCCTGATCTACTGGAACGACGACA AGCGGTACAGCCCCAGCCTGAAGTCCCGGCTGACC ATCACCAAGGACACCTCGAAGAACCAGGTGGTGCT GACCATGACAAACATGGACCCCGTGGACACCGCCA CATATTACTGTGCACACAAAACGACGTCGTTTTAC TTTGACTACTGGGGCCAGGGAACCCTGGTCACCGT GTCCTCAGGCGGAGGTGGAAGCGGAGGGGGAGGA TCTGGCGGCGGAGGAAGCGGAGGCGACATCCAGA TGACCCAGTCTCCATCCTCCCTGTCTGCATCTGTAG GAGACAGAGTCACCATCACTTGCCGGGCAAGTCAG |

TABLE 5-continued

| HLA scFv binding domains | |
|---|---|
| FTLTISSLQPEDFATY YCQQSYSTPLTFGGG TKVEIK (SEQ ID NO: 121) | AGCATTAGCAGCTATTTAAATTGGTATCAGCAGAA ACCAGGGAAAGCCCCTAAGCTCCTGATCTATGCTG CATCCAGTTTGCAAAGTGGGGTCCCATCAAGGTTC AGTGGCAGTGGATCTGGGACAGATTTCACTCTCAC CATCAGCAGTCTGCAACCTGAAGATTTTGCAACTT ACTACTGTCAACAGAGTTACAGTACCCCTCTCACTT TCGGCGGCGGAACAAAGGTGGAGATCAAG (SEQ ID NO: 130) |
| QVQLQESGPGLVKPS QTLSLTCTVSGGSISS GGYYWSWIRQPPGK GLEWIGYIYYSGSTY YNPSLKSRVTISVDTS KNQFSLKLSSVTAAD TAVYYCARHYYYY MDVWGKGTTVTVSS GGGGSGGGGSGGGG SGGDIQMTQSPSSLS ASVGDRVTITCRASQ SISSYLNWYQQKPGK APKLLIYAASSLQSG VPSRFSGSGSGTDFT LTISSLQPEDFATYYC QQSYSTPLTFGGGTK VEIK (SEQ ID NO: 122) | CAGGTGCAGCTGCAGGAAAGCGGCCCTGGCCTGGT GAAACCCAGCCAGACCCTGAGCCTGACCTGCACAG TGTCCGGCGGCTCGATCAGCAGCGGCGGCTACTAC TGGTCCTGGATCAGACAGCCCCCTGGCAAGGGCCT GGAATGGATCGGCTACATCTACTACAGCGGCAGCA CCTACTACAACCCCAGCCTGAAGTCCAGAGTGACC ATCAGCGTGGACACCAGCAAGAACCAGTTCAGCCT GAAGCTGAGCAGCGTGACAGCCGCCGACACCGCT GTGTATTACTGTGCGAGACACTACTACTACTACTA CATGGACGTCTGGGGCAAAGGGACCACGGTCACC GTGTCCTCAGGCGGAGGTGGAAGCGGAGGGGGAG GATCTGGCGGCGGAGGAAGCGGAGGCGACATCCA GATGACCCAGTCTCCATCCTCCCTGTCTGCATCTGT AGGAGACAGAGTCACCATCACTTGCCGGGCAAGTC AGAGCATTAGCAGCTATTTAAATTGGTATCAGCAG AAACCAGGGAAAGCCCCTAAGCTCCTGATCTATGC TGCATCCAGTTTGCAAAGTGGGGTCCCATCAAGGT TCAGTGGCAGTGGATCTGGGACAGATTTCACTCTC ACCATCAGCAGTCTGCAACCTGAAGATTTTGCAAC TTACTACTGTCAACAGAGTTACAGTACCCCTCTCAC TTTCGGCGGCGGAACAAAGGTGGAGATCAAG (SEQ ID NO: 131) |
| HLA-C*07 antigen binding domains | |
| C7-45 | EVQLLESGGGLVQPGGSLRLSCAASGFTFSSYAMSWVRQAPGKGLEW VSAISGSGGSTYYADSVKGRFTISRDNSKNTLYLQMNSLRAEDTAVYYCA VSFDWFDPWGQGTLVTVSSGGGGSGGGGSGGGGSGGDIQMTQSPS SLSASVGDRVTITCRASQSISSYLNWYQQKPGKAPKLLIYAASSLQSGVPS RFSGSGSGTDFTLTISSLQPEDFATYYCQQSYSTPLTFGGGTKVEIK (SEQ ID NO: 570) |
| C7-44 | QVQLQESGPGLVKPSQTLSLTCTVSGGSISSGGYYWSWIRQPPGKGLE WIGYIYYSGSTYYNPSLKSRVTISVDTSKNQFSLKLSSVTAADTAVYYCAR ERSISPYYYYYMDVWGKGTTVTVSSGGGGSGGGGSGGGGSGGDIQM TQSPSSLSASVGDRVTITCRASQSISSYLNWYQQKPGKAPKLLIYAASSLQ SGVPSRFSGSGSGTDFTLTISSLQPEDFATYYCQQSYSTPLTFGGGTKVEI K (SEQ ID NO: 571) |
| C7-43 | QLQLQESGPGLVKPSETLSLTCTVSGGSISSSSYYWGWIRQPPGKGLEWI GSIYYSGSTYYNPSLKSRVTISVDTSKNQFSLKLSSVTAADTAVYYCARDS VIWYWFDPWGQGTLVTVSSGGGGSGGGGSGGGGSGGQSVLTQPPS ASGTPGQRVTISCSGSSSNIGSNTVNWYQQLPGTAPKLLIYSNNQRPSG VPDRFSGSKSGTSASLAISGLQSEDEADYYCAAWDDSLNGWVFGGGTK LTVL (SEQ ID NO: 572) |
| C7-42 | QVQLQESGPGLVKPSQTLSLTCTVSGGSISSGGYYWSWIRQPPGKGLE WIGYIYYSGSTYYNPSLKSRVTISVDTSKNQFSLKLSSVTAADTAVYYCAR EEILPRLSYYYYMDVWGKGTTVTVSSGGGGSGGGGSGGGGSGGDIQM TQSPSSLSASVGDRVTITCRASQSISSYLNWYQQKPGKAPKLLIYAASSLQ SGVPSRFSGSGSGTDFTLTISSLQPEDFATYYCQQSYSTPLTFGGGTKVEI K (SEQ ID NO: 573) |
| C7-41 | QVQLVQSGSELKKPGASVKVSCKASGYTFTSYAMNWVRQAPGQGLE WMGWINTNTGNPTYAQGFTGRFVFSFDTSVSTAYLQICSLKAEDTAVY YCARGGRAHSSWYFDLWGRGTLVTVSSGGGGSGGGGSGGGGSGGDI QMTQSPSSLSASVGDRVTITCRASQSISSYLNWYQQKPGKAPKLLIYAAS SLQSGVPSRFSGSGSGTDFTLTISSLQPEDFATYYCQQSYSTPLTFGGGTK VEIK (SEQ ID NO: 574) |
| C7-40 | QVQLQESGPGLVKPSQTLSLTCTVSGGSISSGGYYWSWIRQPPGKGLE WIGYIYYSGSTYYNPSLKSRVTISVDTSKNQFSLKLSSVTAADTAVYYCAR DRIKILPRLGYYYYMDVWGKGTTVTVSSGGGGSGGGGSGGGGSGGDI QMTQSPSSLSASVGDRVTITCRASQSISSYLNWYQQKPGKAPKLLIYAAS SLQSGVPSRFSGSGSGTDFTLTISSLQPEDFATYYCQQSYSTPLTFGGGTK VEIK (SEQ ID NO: 575) |

TABLE 5-continued

| HLA scFv binding domains | |
|---|---|
| C7-39 | QVQLQESGPGLVKPSQTLSLTCTVSGGSISSGGYYWSWIRQPPGKGLE<br>WIGYIYYSGSTYYNPSLKSRVTISVDTSKNQFSLKLSSVTAADTAVYYCAR<br>DTVIHYYYYMDVWGKGTTVTVSSGGGGSGGGGSGGGGSGGDIQMT<br>QSPSSLSASVGDRVTITCRASQSISSYLNWYQQKPGKAPKLLIYAASSLQS<br>GVPSRFSGSGSGTDFTLTISSLQPEDFATYYCQQSYSTPLTFGGGTKVEIK<br>(SEQ ID NO: 576) |
| C7-38 | QVQLQESGPGLVKPSQTLSLTCTVSGGSISSGGYYWSWIRQPPGKGLE<br>WIGYIYYSGSTYYNPSLKSRVTISVDTSKNQFSLKLSSVTAADTAVYYCAR<br>DVIVEVFLSYYYYMDVWGKGTTVTVSSGGGGSGGGGSGGGGSGGDIQ<br>MTQSPSSLSASVGDRVTITCRASQSISSYLNWYQQKPGKAPKLLIYAASS<br>LQSGVPSRFSGSGSGTDFTLTISSLQPEDFATYYCQQSYSTPLTFGGGTK<br>VEIK (SEQ ID NO: 577) |
| C7-37 | QVQLQESGPGLVKPSQTLSLTCTVSGGSISSGGYYWSWIRQPPGKGLE<br>WIGYIYYSGSTYYNPSLKSRVTISVDTSKNQFSLKLSSVTAADTAVYYCAR<br>DIFIHYYYYMDVWGKGTTVTVSSGGGGSGGGGSGGGGSGGDIQMTQ<br>SPSSLSASVGDRVTITCRASQSISSYLNWYQQKPGKAPKLLIYAASSLQSG<br>VPSRFSGSGSGTDFTLTISSLQPEDFATYYCQQSYSTPLTFGGGTKVEIK<br>(SEQ ID NO: 578) |
| C7-36 | EVQLVESGGGLVQPGGSLRLSCAASGFTFSSYSMNWVRQAPGKGLEW<br>VSYISSSSSTIYYADSVKGRFTISRDNAKNSLYLQMNSLRAEDTAVYYCAR<br>DGTFYSYSPYYFDYWGQGTLVTVSSGGGGSGGGGSGGGGSGGDIQM<br>TQSPSSLSASVGDRVTITCRASQSISSYLNWYQQKPGKAPKLLIYAASSLQ<br>SGVPSRFSGSGSGTDFTLTISSLQPEDFATYYCQQSYSTPLTFGGGTKVEI<br>K (SEQ ID NO: 579) |
| C7-35 | QVQLQESGPGLVKPSQTLSLTCTVSGGSISSGGYYWSWIRQPPGKGLE<br>WIGYIYYSGSTYYNPSLKSRVTISVDTSKNQFSLKLSSVTAADTAVYYCAR<br>EWIKILPRLGYYYYMDVWGKGTTVTVSSGGGGSGGGGSGGGGSGGDI<br>QMTQSPSSLSASVGDRVTITCRASQSISSYLNWYQQKPGKAPKLLIYAAS<br>SLQSGVPSRFSGSGSGTDFTLTISSLQPEDFATYYCQQSYSTPLTFGGGTK<br>VEIK (SEQ ID NO: 580) |
| C7-34 | QVQLQESGPGLVKPSQTLSLTCTVSGGSISSGGYYWSWIRQPPGKGLE<br>WIGYIYYSGSTYYNPSLKSRVTISVDTSKNQFSLKLSSVTAADTAVYYCAR<br>DRSLYYYYYMDVWGKGTTVTVSSGGGGSGGGGSGGGGSGGDIQMT<br>QSPSSLSASVGDRVTITCRASQSISSYLNWYQQKPGKAPKLLIYAASSLQS<br>GVPSRFSGSGSGTDFTLTISSLQPEDFATYYCQQSYSTPLTFGGGTKVEIK<br>(SEQ ID NO: 581) |
| C7-33 | QVQLQESGPGLVKPSQTLSLTCTVSGGSISSGGYYWSWIRQPPGKGLE<br>WIGYIYYSGSTYYNPSLKSRVTISVDTSKNQFSLKLSSVTAADTAVYYCAR<br>DKILAPNYYYYMDVWGKGTTVTVSSGGGGSGGGGSGGGGSGGDIQM<br>TQSPSSLSASVGDRVTITCRASQSISSYLNWYQQKPGKAPKLLIYAASSLQ<br>SGVPSRFSGSGSGTDFTLTISSLQPEDFATYYCQQSYSTPLTFGGGTKVEI<br>K (SEQ ID NO: 582) |
| C7-32 | QVQLQESGPGLVKPSQTLSLTCTVSGGSISSGGYYWSWIRQPPGKGLE<br>WIGYIYYSGSTYYNPSLKSRVTISVDTSKNQFSLKLSSVTAADTAVYYCAR<br>EKSWKYFYYYYYYMDVWGKGTTVTVSSGGGGSGGGGSGGGGSGGDI<br>QMTQSPSSLSASVGDRVTITCRASQSISSYLNWYQQKPGKAPKLLIYAAS<br>SLQSGVPSRFSGSGSGTDFTLTISSLQPEDFATYYCQQSYSTPLTFGGGTK<br>VEIK (SEQ ID NO: 583) |
| C7-31 | QVQLQESGPGLVKPSQTLSLTCTVSGGSISSGGYYWSWIRQPPGKGLE<br>WIGYIYYSGSTYYNPSLKSRVTISVDTSKNQFSLKLSSVTAADTAVYYCAR<br>ENTSTIPYYYYYMDVWGKGTTVTVSSGGGGSGGGGSGGGGSGGDIQ<br>MTQSPSSLSASVGDRVTITCRASQSISSYLNWYQQKPGKAPKLLIYAASS<br>LQSGVPSRFSGSGSGTDFTLTISSLQPEDFATYYCQQSYSTPLTFGGGTK<br>VEIK (SEQ ID NO: 584) |
| C7-30 | QVQLQESGPGLVKPSQTLSLTCTVSGGSISSGGYYWSWIRQPPGKGLE<br>WIGYIYYSGSTYYNPSLKSRVTISVDTSKNQFSLKLSSVTAADTAVYYCAR<br>EDVDKNTSTIYYYYYYMDVWGKGTTVTVSSGGGGSGGGGSGGGGSG<br>GDIQMTQSPSSLSASVGDRVTITCRASQSISSYLNWYQQKPGKAPKLLIY<br>AASSLQSGVPSRFSGSGSGTDFTLTISSLQPEDFATYYCQQSYSTPLTFGG<br>GTKVEIK (SEQ ID NO: 585) |
| C7-29 | QVQLVESGGGLVKPGGSLRLSCAASGFTFSDYYMSWIRQAPGKGLEW<br>VSYISSSGSTIYYADSVKGRFTISRDNAKNSLYLQMNSLRAEDTAVYYCAR<br>DGGDIVSSSAIYWYFDLWGRGTLVTVSSGGGGSGGGGSGGGGSGGAI<br>QLTQSPSSLSASVGDRVTITCRASQGISSALAWYQQKPGKAPKLLIYDAS<br>SLESGVPSRFSGSGSGTDFTLTISSLQPEDFATYYCQQFNSYPLTFGGGT<br>KVEIK (SEQ ID NO: 586) |

TABLE 5-continued

HLA scFv binding domains

C7-28
QVQLQESGPGLVKPSQTLSLTCTVSGGSISSGGYYWSWIRQPPGKGLE
WIGYIYYSGSTYYNPSLKSRVTISVDTSKNQFSLKLSSVTAADTAVYYCAR
DLILPPYYYYYMDVWGKGTTVTVSSGGGGSGGGGSGGGGSGGDIQM
TQSPSSLSASVGDRVTITCRASQSISSYLNWYQQKPGKAPKLLIYAASSLQ
SGVPSRFSGSGSGTDFTLTISSLQPEDFATYYCQQSYSTPLTFGGGTKVEI
K (SEQ ID NO: 587)

C7-27
QVQLQESGPGLVKPSQTLSLTCTVSGGSISSGGYYWSWIRQPPGKGLE
WIGYIYYSGSTYYNPSLKSRVTISVDTSKNQFSLKLSSVTAADTAVYYCAR
ETWIKILPRYYYYYYMDVWGKGTTVTVSSGGGGSGGGGSGGGGSGG
DIQMTQSPSSLSASVGDRVTITCRASQSISSYLNWYQQKPGKAPKLLIYA
ASSLQSGVPSRFSGSGSGTDFTLTISSLQPEDFATYYCQQSYSTPLTFGGG
TKVEIK (SEQ ID NO: 588)

C7-26
QVQLQESGPGLVKPSQTLSLTCTVSGGSISSGGYYWSWIRQPPGKGLE
WIGYIYYSGSTYYNPSLKSRVTISVDTSKNQFSLKLSSVTAADTAVYYCAR
DLSRYYYYYMDVWGKGTTVTVSSGGGGSGGGGSGGGGSGGDIQMT
QSPSSLSASVGDRVTITCRASQSISSYLNWYQQKPGKAPKLLIYAASSLQS
GVPSRFSGSGSGTDFTLTISSLQPEDFATYYCQQSYSTPLTFGGGTKVEIK
(SEQ ID NO: 589)

C7-25
EVQLVESGGGLVQPGGSLRLSCAASGFTFSSYSMNWVRQAPGKGLEW
VSYISSSSSTIYYADSVKGRFTISRDNAKNSLYLQMNSLRAEDTAVYYCAR
EHIVLCFDYWGQGTLVTVSSGGGGSGGGGSGGGGSGGDIQMTQSPSS
LSASVGDRVTITCRASQGISSWUXWYQQKPEKAPKSLIYAASSLQSGVPS
RFSGSGSGTDFTLTISSLQPEDFATYYCQQYNSYPLTFGGGTKVEIK (SEQ
ID NO: 590)

C7-24
QVQLQESGPGLVKPSQTLSLTCTVSGGSISSGGYYWSWIRQPPGKGLE
WIGYIYYSGSTYYNPSLKSRVTISVDTSKNQFSLKLSSVTAADTAVYYCAR
DKILPRPYYYYMDVWGKGTTVTVSSGGGGSGGGGSGGGGSGGDIQ
MTQSPSSLSASVGDRVTITCRASQSISSYLNWYQQKPGKAPKLLIYAASS
LQSGVPSRFSGSGSGTDFTLTISSLQPEDFATYYCQQSYSTPLTFGGGTK
VEIK (SEQ ID NO: 591)

C7-23
QVQLVQSGAEVKKPGASVKVSCKASGYTFTSYGISWVRQAPGQGLEW
MGWISAYNGNTNYAQKLQGRVTMTTDTSTSTAYMELRSLRSDDTAVY
YCARGSNEYFQHWGQGTLVTVSSGGGGSGGGGSGGGGSGGQSALTQ
PPSASGSPGQSVTISCTGTSSDVGGYNYVSWYQQHPGKAPKLMIYEVS
KRPSGVPDRFSGSKSGNTASLTVSGLQAEDEADYYCSSYAGSNNWVFG
GGTKLTVL (SEQ ID NO: 592)

C7-22
QVQLVQSGSELKKPGASVKVSCKASGYTFTSYAMNWVRQAPGQGLE
WMGWINTNTGNPTYAQGFTGRFVFSFDTSVSTAYLQICSLKAEDTAVY
YCARGTSYWYFDLWGRGTLVTVSSGGGGSGGGGSGGGGSGGDIQMT
QSPSSLSASVGDRVTITCRASQSISSYLNWYQQKPGKAPKLLIYAASSLQS
GVPSRFSGSGSGTDFTLTISSLQPEDFATYYCQQSYSTPLTFGGGTKVEIK
(SEQ ID NO: 593)

C7-21
QVQLQESGPGLVKPSQTLSLTCTVSGGSISSGGYYWSWIRQPPGKGLE
WIGYIYYSGSTYYNPSLKSRVTISVDTSKNQFSLKLSSVTAADTAVYYCAR
EEIVEVFYYYYMDVWGKGTTVTVSSGGGGSGGGGSGGGGSGGDIQM
TQSPSSLSASVGDRVTITCRASQSISSYLNWYQQKPGKAPKLLIYAASSLQ
SGVPSRFSGSGSGTDFTLTISSLQPEDFATYYCQQSYSTPLTFGGGTKVEI
K (SEQ ID NO: 594)

C7-20
EVQLLESGGGLVQPGGSLRLSCAASGFTFSSYAMSWVRQAPGKGLEW
VSAISGSGGSTYYADSVKGRFTISRDNSKNTLYLQMNSLRAEDTAVYYCA
KVDDYYFDYWGQGTLVTVSSGGGGSGGGGSGGGGSGGDIQMTQSPS
SLSASVGDRVTITCRASQSISSYLNWYQQKPGKAPKLLIYAASSLQSGVPS
RFSGSGSGTDFTLTISSLQPEDFATYYCQQSYSTPLTFGGGTKVEIK (SEQ
ID NO: 595)

C7-19
EVQLVESGGGLVQPGGSLRLSCAASGFTFSSYWMHWVRQAPGKGLV
WVSRINSDGSSTSYADSVKGRFTISRDNAKNTLYLQMNSLRAEDTAVYY
CAWSTNILLSYTKAFDIWGQGTMVTVSSGGGGSGGGGSGGGGSGGDI
QMTQSPSSLSASVGDRVTITCRASQSISSYLNWYQQKPGKAPKLLIYAAS
SLQSGVPSRFSGSGSGTDFTLTISSLQPEDFATYYCQQSYSTPLTFGGGTK
VEIK (SEQ ID NO: 596)

C7-18
QVQLQESGPGLVKPSQTLSLTCTVSGGSISSGGYYWSWIRQPPGKGLE
WIGYIYYSGSTYYNPSLKSRVTISVDTSKNQFSLKLSSVTAADTAVYYCAR
DKTYYYYYYMDVWGKGTTVTVSSGGGGSGGGGSGGGGSGGDIQMT
QSPSSLSASVGDRVTITCRASQSISSYLNWYQQKPGKAPKLLIYAASSLQS
GVPSRFSGSGSGTDFTLTISSLQPEDFATYYCQQSYSTPLTFGGGTKVEIK
(SEQ ID NO: 597)

TABLE 5-continued

HLA scFv binding domains

| | |
|---|---|
| C7-17 | QVQLQESGPGLVKPSQTLSLTCTVSGGSISSGGYYWSWIRQPPGKGLE WIGYIYYSGSTYYNPSLKSRVTISVDTSKNQFSLKLSSVTAADTAVYYCAR EKYFHDKYFHDYYYYYMDVWGKGTTVTVSSGGGGSGGGGSGGGGSG GDIQMTQSPSSLSASVGDRVTITCRASQSISSYLNWYQQKPGKAPKLLIY AASSLQSGVPSRFSGSGSGTDFTLTISSLQPEDFATYYCQQSYSTPLTFGG GTKVEIK (SEQ ID NO: 598) |
| C7-16 | QVQLQESGPGLVKPSQTLSLTCTVSGGSISSGGYYWSWIRQPPGKGLE WIGYIYYSGSTYYNPSLKSRVTISVDTSKNQFSLKLSSVTAADTAVYYCAR DTSVYYYYYMDVWGKGTTVTVSSGGGGSGGGGSGGGGSGGDIQMT QSPSSLSASVGDRVTITCRASQSISSYLNWYQQKPGKAPKLLIYAASSLQS GVPSRFSGSGSGTDFTLTISSLQPEDFATYYCQQSYSTPLTFGGGTKVEIK (SEQ ID NO: 599) |
| C7-15 | QVQLQESGPGLVKPSQTLSLTCTVSGGSISSGGYYWSWIRQPPGKGLE WIGYIYYSGSTYYNPSLKSRVTISVDTSKNQFSLKLSSVTAADTAVYYCAR EKILPYYYYYYMDVWGKGTTVTVSSGGGGSGGGGSGGGGSGGDIQM TQSPSSLSASVGDRVTITCRASQSISSYLNWYQQKPGKAPKLLIYAASSLQ SGVPSRFSGSGSGTDFTLTISSLQPEDFATYYCQQSYSTPLTFGGGTKVE K (SEQ ID NO: 600) |
| C7-14 | EVQLVESGGGLVQPGGSLRLSCAASGFTFSSYSMNWVRQAPGKGLEW VSYISSSSSTIYYADSVKGRFTISRDNAKNSLYLQMNSLRAEDTAVYYCAI QWIYIYINPRGFIFLHDAFDIWGQGTMVTVSSGGGGSGGGGSGGGGS GGGQSVLTQPPSASGTPGQRVTISCSGSSSNIGSNTVNWYQQLPGTAPK LLIYSNNQRPSGVPDRFSGSKSGTSASLAISGLQSEDEADYYCAAWDDSL NGWVFGGGTKLTVL (SEQ ID NO: 601) |
| C7-13 | QVQLQQSGPGLVKPSQTLSLTCAISGDSVSSNSAAWNWIRQSPSRGLE WLGRTYYRSKWYNDYAVSVKSRITINPDTSKNQFSLQLNSVTPEDTAVY YCAKEDVDFHHDAFDIWGQGTMVTVSSGGGGSGGGGSGGGGSGGDI QMTQSPSSLSASVGDRVTITCRASQSISSYLNWYQQKPGKAPKLLIYAAS SLQSGVPSRFSGSGSGTDFTLTISSLQPEDFATYYCQQSYSTPLTFGGGTK VEIK (SEQ ID NO: 602) |
| C7-12 | QVQLQESGPGLVKPSQTLSLTCTVSGGSISSGGYYWSWIRQPPGKGLE WIGYIYYSGSTYYNPSLKSRVTISVDTSKNQFSLKLSSVTAADTAVYYCAR EGVDKNTSTIYYYYYYYMDVWGKGTTVTVSSGGGGSGGGGSGGGGSG GDIQMTQSPSSLSASVGDRVTITCRASQSISSYLNWYQQKPGKAPKLLIY AASSLQSGVPSRFSGSGSGTDFTLTISSLQPEDFATYYCQQSYSTPLTFGG GTKVEIK (SEQ ID NO: 603) |
| C7-11 | EVQLVESGGGLVQPGGSLRLSCAASGFTFSSYSMNWVRQAPGKGLEW VSYISSSSSTIYYADSVKGRFTISRDNAKNSLYLQMNSLRAEDTAVYYCAR DRRGYFDLWGRGTLVTVSSGGGGSGGGGSGGGGSGGDIQMTQSPSS LSASVGDRVTITCRASQGISSWUXWYQQKPEKAPKSLIYAASSLQSGVPS RFSGSGSGTDFTLTISSLQPEDFATYYCQQYNSYPLTFGGGTKVEIK (SEQ ID NO: 604) |
| C7-10 | EVQLVQSGAEVKKPGATVKISCKVSGYTFTDYYMHWVQQAPGKGLEW MGLVDPEDGETIYAEKFQGRVTITADTSTDTAYMELSSLRSEDTAVYYC ATGIHVDIRSMEDWFDPWGQGTLVTVSSGGGGSGGGGSGGGGSGG DIQMTQSPSSLSASVGDRVTITCRASQSISSYLNWYQQKPGKAPKLLIYA ASSLQSGVPSRFSGSGSGTDFTLTISSLQPEDFATYYCQQSYSTPLTFGGG TKVEIK (SEQ ID NO: 605) |
| C7-9 | QVQLQESGPGLVKPSQTLSLTCTVSGGSISSGGYYWSWIRQPPGKGLE WIGYIYYSGSTYYNPSLKSRVTISVDTSKNQFSLKLSSVTAADTAVYYCAR DIGTSYYYYMDVWGKGTTVTVSSGGGGSGGGGSGGGGSGGDIQMTQ SPSSLSASVGDRVTITCRASQSISSYLNWYQQKPGKAPKLLIYAASSLQSG VPSRFSGSGSGTDFTLTISSLQPEDFATYYCQQSYSTPLTFGGGTKVEIK (SEQ ID NO: 606) |
| C7-8 | QVQLQESGPGLVKPSQTLSLTCTVSGGSISSGGYYWSWIRQPPGKGLE WIGYIYYSGSTYYNPSLKSRVTISVDTSKNQFSLKLSSVTAADTAVYYCAR EVVEVFLYYYYYMDVWGKGTTVTVSSGGGGSGGGGSGGGGSGGDIQ MTQSPSSLSASVGDRVTITCRASQSISSYLNWYQQKPGKAPKLLIYAASS LQSGVPSRFSGSGSGTDFTLTISSLQPEDFATYYCQQSYSTPLTFGGGTK VEIK (SEQ ID NO: 607) |
| C7-7 | QVQLQESGPGLVKPSQTLSLTCTVSGGSISSGGYYWSWIRQPPGKGLE WIGYIYYSGSTYYNPSLKSRVTISVDTSKNQFSLKLSSVTAADTAVYYCAR DLYYYYYYYMDVWGKGTTVTVSSGGGGSGGGGSGGGGSGGDIQMT QSPSSLSASVGDRVTITCRASQSISSYLNWYQQKPGKAPKLLIYAASSLQS GVPSRFSGSGSGTDFTLTISSLQPEDFATYYCQQSYSTPLTFGGGTKVEIK (SEQ ID NO: 608) |

TABLE 5-continued

| HLA scFv binding domains | |
|---|---|
| C7-6 | QVQLQESGPGLVKPSQ.TLSLTCTVSGGSISSGGYYWSWIRQPPGKGLE WIGYIYYSGSTYYNPSLKSRVTISVDTSKNQFSLKLSSVTAADTAVYYCAR ESWKFYFPRGSIFIHYYYYMDVWGKGTTVTVSSGGGGSGGGGSGGGG SGGDIQMTQSPSSLSASVGDRVTITCRASQSISSYLNWYQQKPGKAPKL LIYAASSLQSGVPSRFSGSGSGTDFTLTISSLQPEDFATYYCQQSYSTPLTF GGGTKVEIK (SEQ ID NO: 609) |
| C7-5 | QVQLQESGPGLVKPSQTLSLTCTVSGGSISSGGYYWSWIRQPPGKGLE WIGYIYYSGSTYYNPSLKSRVTISVDTSKNQFSLKLSSVTAADTAVYYCAR DRIVEVFYYYYMDVWGKGTTVTVSSGGGGSGGGGSGGGGSGGDIQM TQSPSSLSASVGDRVTITCRASQSISSYLNWYQQKPGKAPKLLIYAASSLQ SGVPSRFSGSGSGTDFTLTISSLQPEDFATYYCQQSYSTPLTFGGGTKVEI K (SEQ ID NO: 610) |
| C7-4 | QVQLQESGPGLVKPSQTLSLTCTVSGGSISSGGYYWSWIRQPPGKGLE WIGYIYYSGSTYYNPSLKSRVTISVDTSKNQFSLKLSSVTAADTAVYYCAR EKYFHDWLYYYYMDVWGKGTTVTVSSGGGGSGGGGSGGGGSGGDI QMTQSPSSLSASVGDRVTITCRASQSISSYLNWYQQKPGKAPKLLIYAAS SLQSGVPSRFSGSGSGTDFTLTISSLQPEDFATYYCQQSYSTPLTFGGGTK VEIK (SEQID NO: 611) |
| C7-3 | QVQLQESGPGLVKPSQTLSLTCTVSGGSISSGGYYWSWIRQPPGKGLE WIGYIYYSGSTYYNPSLKSRVTISVDTSKNQFSLKLSSVTAADTAVYYCAR DLVDKNTSYYYYYMDVWGKGTTVTVSSGGGGSGGGGSGGGGSGGDI QMTQSPSSLSASVGDRVTITCRASQSISSYLNWYQQKPGKAPKLLIYAAS SLQSGVPSRFSGSGSGTDFTLTISSLQPEDFATYYCQQSYSTPLTFGGGTK VEIK (SEQID NO: 612) |
| C7-2 | QVQLVQSGAEVKKPGASVKVSCKASGYTFTSYGISWVRQAPGQGLEW MGWISAYNGNTNYAQKLQGRVTMTTDTSTSTAYMELRSLRSDDTAVY YCARVQNEYFQHWGQGTLVTVSSGGGGSGGGGSGGGGSGQSALT QPPSASGSPGQSVTISCTGTSSDVGGYNYVSWYQQHPGKAPKLMIYEV SKRPSGVPDRFSGSKSGNTASLTVSGLQAEDEADYYCSSYAGSNNWVF GGGTKLTVL (SEQ ID NO: 613) |
| C7-1 | QVQLVESGGGLVKPGGSLRLSCAASGFTFSDYYMSWIRQAPGKGLEW VSYISSSGSTIYYADSVKGRFTISRDNAKNSLYLQMNSLRAEDTAVYYCAT ANWFDPWGQGTLVTVSSGGGGSGGGGSGGGGSGGDIQMTQSPSSV SASVGDRVTITCRASQGISSWUXWYQQKPGKAPKLLIYAASSLQSGVPS RFSGSGSGTDFTLTISSLQPEDFATYYCQQANSFPLTFGGGTKVEIK (SEQ ID NO: 614) |
| HLA-A*03 scFv Sequences | |
| 15 | QVQLVQSGAEVKKPGASVKVSCKASGYTFTSYGISW VRQAPGQGLEWMGWISAYNGNTNYAQKLQGRVTM TTDTSTSTAYMELRSLRSDDTAVYYCARERVSQRGA FDIWGQGTMVTVSSGGGGSGGGGSGGGGSGGDIQM TQSPSSLSASVGDRVTITCRASQSISSYLNWYQQKPG KAPKLLIYAASSLQSGVPSRFSGSGSGTDFTLTISSLQP EDFATYYCQQSYSTPLTFGGGTKVEIK (SEQ ID NO: 615) |
| 16 | EVQLVESGGGLVQPGGSLRLSCAASGFTFSSYSMNW VRQAPGKGLEWVSYISSSSSTIYYADSVKGRFTISRD NAKNSLYLQMNSLRAEDTAVYYCARGNPDKDPFDY WGQGTLVTVSSGGGGSGGGGSGGGGSGGDIQMTQS PSSLSASVGDRVTITCRASQSISSYLNWYQQKPGKAP KLLIYAASSLQSGVPSRFSGSGSGTDFTLTISSLQPEDF ATYYCQQSYSTPLTFGGGTKVEIK (SEQ ID NO: 616) |
| 17 | QVQLQESGPGLVKPSETLSLTCTVSGGSVSSGSYYWS WIRQPPGKGLEWIGYIYYSGSTNYNPSLKSRVTISVDT SKNQFSLKLSSVTAADTAVYYCARDFYCTNWYFDL WGRGTLVTVSSGGGGSGGGGSGGGGSGGDIQMTQS PSSLSASVGDRVTITCRASQSISSYLNWYQQKPGKAP KLLIYAASSLQSGVPSRFSGSGSGTDFTLTISSLQPEDF ATYYCQQSYSTPLTFGGGTKVEIK (SEQ ID NO: 617) |
| 18 | QVQLQESGPGLVKPSETLSLTCTVSGGSISSYYWSWI RQPPGKGLEWIGYIYYSGSTNYNPSLKSRVTISVDTSK NQFSLKLSSVTAADTAVYYCARESSSGSYWYFDLWG RGTLVTVSSGGGGSGGGGSGGGGSGGDIQMTQSPSS LSASVGDRVTITCRASQSISSYLNWYQQKPGKAPKLL IYAASSLQSGVPSRFSGSGSGTDFTLTISSLQPEDFATY YCQQSYSTPLTFGGGTKVEIK (SEQ ID NO: 618) |

TABLE 5-continued

HLA scFv binding domains

| | |
|---|---|
| 19 | EVQLVQSGAEVKKPGESLKISCKGSGYSFTSYWIGW VRQMPGKGLEWMGIIYPGDSDTRYSPSFQGQVTISAD KSISTAYLQWSSLKASDTAMYYCARDSGYKYNLYY YYYYMDVWGKGTTVTVSSGGGGSGGGGSGGGGSG GDIQMTQSPSSLSASVGDRVTITCRASQSISSYLNWY QQKPGKAPKLLIYAASSLQSGVPSRFSGSGSGTDFTL TISSLQPEDFATYYCQQSYSTPLTFGGGTKVEIK (SEQ ID NO: 619) |
| 20 | QVQLVQSGAEVKKPGASVKVSCKASGYTFTSYGISW VRQAPGQGLEWMGWISAYNGNTNYAQKLQGRVTM TTDTSTSTAYMELRSLRSDDTAVYYCARGGDLSHYY YYMDVWGKGTTVTVSSGGGGSGGGGSGGGGSGGQ TVVTQEPSLTVSPGGTVTLTCASSTGAVTSGYYPNWF QQKPGQAPRALIYSTSNKHSWTPARFSGSLLGGKAA LTLSGVQPEDEAEYYCLLYYGGAQWVFGGGTKLTV L (SEQ ID NO: 620) |
| 21 | QVQLVQSGAEVKKPGASVKVSCKASGYTFTSYGISW VRQAPGQGLEWMGWISAYNGNTNYAQKLQGRVTM TTDTSTSTAYMELRSLRSDDTAVYYCARENRRYNSC YYFDYWGQGTLVTVSSGGGGSGGGGSGGGGSGGDI QMTQSPSSLSASVGDRVTITCRASQSISSYLNWYQQK PGKAPKLLIYAASSLQSGVPSRFSGSGSGTDFTLTISSL QPEDFATYYCQQSYSTPLTFGGGTKVEIK (SEQ ID NO: 621) |
| 22 | QVQLVQSGAEVKKPGASVKVSCKASGYTFTSYGISW VRQAPGQGLEWMGWISAYNGNTNYAQKLQGRVTM TTDTSTSTAYMELRSLRSDDTAVYYCARGGDLSHYY YYLDVWGKGTTVTVSSGGGGSGGGGSGGGGSGGQT VVTQEPSLTVSPGGTVTLTCASSTGAVTSGYYPNWF QQKPGQAPRALIYSTSNKHSWTPARFSGSLLGGKAA LTLSGVQPEDEAEYYCLLYYGGAQWVFGGGTKLTV L (SEQ ID NO: 622) |
| 23 | EVQLVESGGGLVQPGGSLRLSCAASGFTVSSNYMSW VRQAPGKGLEWVSVIYSGGSTYYADSVKGRFTISRD NSKNTLYLQMNSLRAEDTAVYYCARATLLSLSYDAF DIWGQGTMVTVSSGGGGSGGGGSGGGGSGGDIQMT QSPSSLSASVGDRVTITCRASQSISSYLNWYQQKPGK APKLLIYAASSLQSGVPSRFSGSGSGTDFTLTISSLQPE DFATYYCQQSYSTPLTFGGGTKVEIK (SEQ ID NO: 623) |
| 24 | QVQLVQSGAEVKKPGASVKVSCKASGYTFTSYGISW VRQAPGQGLEWMGWISAYNGNTNYAQKLQGRVTM TTDTSTSTAYMELRSLRSDDTAVYYCARGGDLSHYY YMDVWGKGTTVTVSSGGGGSGGGGSGGGGSGGQT VVTQEPSLTVSPGGTVTLTCASSTGAVTSGYYPNWF QQKPGQAPRALIYSTSNKHSWTPARFSGSLLGGKAA LTLSGVQPEDEAEYYCLLYYGGAQWVFGGGTKLTV L (SEQ ID NO: 624) |
| 25 | EVQLVQSGAEVKKPGESLKISCKGSGYSFTSYWIGW VRQMPGKGLEWMGIIYPGDSDTRYSPSFQGQVTISAD KSISTAYLQWSSLKASDTAMYYCARERDRWFDPWG QGTLVTVSSGGGGSGGGGSGGGGSGGDIQMTQSPSS LSASVGDRVTITCRASQSISSYLNWYQQKPGKAPKLL IYAASSLQSGVPSRFSGSGSGTDFTLTISSLQPEDFATY YCQQSYSTPLTFGGGTKVEIK (SEQ ID NO: 625) |
| 26 | QVQLVQSGAEVKKPGASVKVSCKASGYTFTSYGISW VRQAPGQGLEWMGWISAYNGNTNYAQKLQGRVTM TTDTSTSTAYMELRSLRSDDTAVYYCARETPPSLGAF DIWGQGTMVTVSSGGGGSGGGGSGGGGSGGQSALT QPPSASGSPGQSVTISCTGTSSDVGGYNYVSWYQHP GKAPKLMIYEVSKRPSGVPDRFSGSKSGNTASLTVSG LQAEDEADYYCSSYAGSNNWVFGGGTKLTVL (SEQ ID NO: 626) |

TABLE 5-continued

| | HLA scFv binding domains |
|---|---|
| 27 | QLQLQESGPGLVKPSETLSLTCTVSGGSISSSSYYWG WIRQPPGKGLEWIGSIYYSGSTYYNPSLKSRVTISVDT SKNQFSLKLSSVTAADTAVYYCAREAYCLSDSYWYF DLWGRGTLVTVSSGGGGSGGGGSGGGGSGGQSVLT QPPSASGTPGQRVTISCSGSSSNIGSNTVNWYQQLPG TAPKLLIYSNNQRPSGVPDRFSGSKSGTSASLAISGLQ SEDEADYYCAAWDDSLNGWVFGGGTKLTVL (SEQ ID NO: 627) |
| 28 | QVQLQESGPGLVKPSQTLSLTCTVSGGSISSGGYYWS WIRQPPGKGLEWIGYIYYSGSTYYNPSLKSRVTISVDT SKNQFSLKLSSVTAADTAVYYCARESWKYFYPRGY MDVWGKGTTVTVSSGGGGSGGGGSGGGGSGGDIQ MTQSPSSLSASVGDRVTITCRASQSISSYLNWYQQKP GKAPKLLIYAASSLQSGVPSRFSGSGSGTDFTLTISSL QPEDFATYYCQQSYSTPLTFGGGTKVEIK (SEQ ID NO: 628) |

| | HLA-A*01 scFv Sequences |
|---|---|
| A1-9 | QVQLVQSGAEVKKPGASVKVSCKASGYTFTSYGISW VRQAPGQGLEWMGWISAYNGNTNYAQKLQGRVTM TTDTSTSTAYMELRSLRSDDTAVYYCARGGWTAWY YYMDVWGKGTTVTVSSGGGGSGGGGSGGGGSGGQ TVVTQEPSLTVSPGGTVTLTCASSTGAVTSGYYPNWF QQKPGQAPRALIYSTSNKHSWTPARFSGSLLGGKAA LTLSGVQPEDEAEYYCLLYYGGAQWVFGGGTKLTV L (SEQ ID NO: 629) |
| A1-8 | EVQLVESGGGLVQPGGSLRLSCAASGFTFSSYSMNW VRQAPGKGLEWVSYISSSSSTIYYADSVKGRFTISRD NAKNSLYLQMNSLRAEDTAVYYCARAKYYYMDVW GKGTTVTVSSGGGGSGGGGSGGGGSGGQSVLTQPPS ASGTPGQRVTISCSGSSSNIGSNTVNWYQQLPGTAPK LLIYSNNQRPSGVPDRFSGSKSGTSASLAISGLQSEDE ADYYCAAWDDSLNGWVFGGGTKLTVL (SEQ ID NO: 630) |
| A1-7 | QVQLQESGPGLVKPSQTLSLTCTVSGGSISSGGYYWS WIRQPPGKGLEWIGYIYYSGSTYYNPSLKSRVTISVDT SKNQFSLKLSSVTAADTAVYYCARDQVDKNTYYYY MDVWGKGTTVTVSSGGGGSGGGGSGGGGSGGDIQ MTQSPSSLSASVGDRVTITCRASQSISSYLNWYQQKP GKAPKLLIYAASSLQSGVPSRFSGSGSGTDFTLTISSL QPEDFATYYCQQSYSTPLTFGGGTKVEIK (SEQ ID NO: 631) |
| A1-6 | QVQLVESGGGLVKPGGSLRLSCAASGFTFSDYYMSW IRQAPGKGLEWVSYISSSGSTIYYADSVKGRFTISRDN AKNSLYLQMNSLRAEDTAVYYCARACQLAEYFQHW GQGTLVTVSSGGGGSGGGGSGGGGSGGDIQMTQSPS SVSASVGDRVTITCRASQGISSWLAWYQQKPGKAPK LLIYAASSLQSGVPSRFSGSGSGTDFTLTISSLQPEDFA TYYCQQANSFPPLTFGGGTKVEIK (SEQ ID NO: 632) |
| A1-5 | QVQLQESGPGLVKPSQTLSLTCTVSGGSISSGGYYWS WIRQPPGKGLEWIGYIYYSGSTYYNPSLKSRVTISVDT SKNQFSLKLSSVTAADTAVYYCARDRVDKNTSYYY MDVWGKGTTVTVSSGGGGSGGGGSGGGGSGGDIQ MTQSPSSLSASVGDRVTITCRASQSISSYLNWYQQKP GKAPKLLIYAASSLQSGVPSRFSGSGSGTDFTLTISSL QPEDFATYYCQQSYSTPLTFGGGTKVEIK (SEQ ID NO: 633) |
| A1-4 | QVQLQESGPGLVKPSDTLSLTCAVSGYSISSSNWWG WIRQPPGKGLEWIGYIYYSGSTYYNPSLKSRVTMSVD TSKNQFSLKLSSVTAVDTAVYYCARRVQLKLVHWF DPWGQGTLVTVSSGGGGSGGGGSGGGGSGGDIQMT QSPSSLSASVGDRVTITCRASQSISSYLNWYQQKPGK APKLLIYAASSLQSGVPSRFSGSGSGTDFTLTISSLQPE DFATYYCQQSYSTPLTFGGGTKVEIK (SEQ ID NO: 634) |
| A1-3 | QVQLVQSGAEVKKPGASVKVSCKASGYTFTSYDINW VRQATGQGLEWMGWMNPNSGNTGYAQKFQGRVT MTRNTSISTAYMELSSLRSEDTAVYYCATYYDYVTV FYFQHWGQGTLVTVSSGGGGSGGGGSGGGGSGGDI |

TABLE 5-continued

| | HLA scFv binding domains |
|---|---|
| | QMTQSPSSLSASVGDRVTITCRASQSISSYLNWYQQK PGKAPKLLIYAASSLQSGVPSRFSGSGSGTDFTLTISSL QPEDFATYYCQQSYSTPLTFGGGTKVEIK (SEQ ID NO: 635) |
| A1-2 | QLQLQESGSGLVKPSQTLSLTCAVSGGSISSGGYSWS WIRQPPGKGLEWIGYIYHSGSTYYNPSLKSRVTISVD RSKNQFSLKLSSVTAADTAVYYCARESYPSFYAFDIW GQGTMVTVSSGGGGSGGGGSGGGGSGGDIQMTQSP SSLSASVGDRVTITCRASQSISSYLNWYQQKPGKAPK LLIYAASSLQSGVPSRFSGSGSGTDFTLTISSLQPEDFA TYYCQQSYSTPLTFGGGTKVEIK (SEQ ID NO: 636) |
| A1-1 | QITLKESGPTLVKPTQTLTLTCTFSGFSLSTSGVGVGW IRQPPGKALEWLALIYWNDDKRYSPSLKSRLTITKDT SKNQVVLTMTNMDPVDTATYYCAHSNMWSYSLND YYFDYWGQGTLVTVSSGGGGSGGGGSGGGGSGGDI QMTQSPSSLSASVGDRVTITCRASQSISSYLNWYQQK PGKAPKLLIYAASSLQSGVPSRFSGSGSGTDFTLTISSL QPEDFATYYCQQSYSTPLTFGGGTKVEIK (SEQ ID NO: 637) |

In some embodiments, the ligand binding domain of the second, inhibitory receptor comprises an scFv. In some embodiments, the scFv binds to HLA-A*01, HLA-A*02, HLA-A*3, HLA-A*11, HLA-B*07 or HLA-C*07, and comprises a sequence selected from the group of sequences set forth in Table 5, or a sequence having at least 80%, at least 85%, at least 90%, at least 95%, at least 97% or at least 99% identity thereto. In some embodiments, the scFv binds to HLA-A*01, HLA-A*02, HLA-A*3, HLA-A*11, HLA-B*07 or HLA-C*07, and comprises a sequence selected from the group of sequences set forth in Table 5. In some embodiments, the non-target antigen comprises HLA-A*01, and the non-target extracellular ligand binding domain of the second receptor comprises an HLA-A*01 scFv sequence set forth in Table 5, or a sequence having at least 80%, at least 85%, at least 90%, at least 95%, at least 97% or at least 99% identity thereto. In some embodiments, the non-target antigen comprises HLA-A*02, and the non-target extracellular ligand binding domain of the second receptor comprises an HLA-A*02 scFv sequence set forth in Table 5, or a sequence having at least 80%, at least 85%, at least 90%, at least 95%, at least 97% or at least 99% identity thereto. In some embodiments, the non-target antigen comprises HLA-A*03, and the non-target extracellular ligand binding domain of the second receptor comprises an HLA-A*03 scFv sequence set forth in Table 5, or a sequence having at least 80%, at least 85%, at least 90%, at least 95%, at least 97% or at least 99% identity thereto. In some embodiments, the non-target antigen comprises HLA-A*11, and the non-target extracellular ligand binding domain of the second receptor comprises an HLA-A*11 scFv sequence set forth in Table 5, or a sequence having at least 80%, at least 85%, at least 90%, at least 95%, at least 97% or at least 99% identity thereto. In some embodiments, the non-target antigen comprises HLA-B*07, and the non-target extracellular ligand binding domain of the second receptor comprises an HLA-B*07 scFv sequence set forth in Table 5, or a sequence having at least 80%, at least 85%, at least 90%, at least 95%, at least 97% or at least 99% identity thereto. In some embodiments, the non-target antigen comprises HLA-C*07, and the non-target extracellular ligand binding domain of the second receptor comprises an HLA-C*07 scFv sequence set forth in Table 5, or a sequence having at least 80%, at least 85%, at least 90%, at least 95%, at least 97% or at least 99% identity thereto.

Exemplary heavy chain and light chain CDRs (CDR-H1, CDR-H2 and CDR-H3, or CDR-L1, CDR-L2 and CDR-L3, respectively) for HLA-A*01, HLA-A*02, HLA-A*03, HLA-A*11, HLA-B*07 and HLA-C*07 ligand binding domains are shown in Table 6 below.

TABLE 6

| CDRs corresponding to HLA antigen binding domains CDR-H3 | | | | | |
|---|---|---|---|---|---|
| CDR-L1 | CDR-L2 | CDR-L3 | CDR-H1 | CDR-H2 | CDR-H3 |
| RSSQSIVHSNGNTYLE (SEQ ID NO: 42) | KVSNRFSGVPDR (SEQ ID NO: 43) | FQGSHVP RT (SEQ ID NO: 44) | ASGYTFTSYHIH (SEQ ID NO: 45) | WIYPGNVNTEYNEKFK GK (SEQ ID NO: 46) | EEITYAMDY (SEQ ID NO: 47) |
| RSSQSIVHSNGNTYLD (SEQ ID NO: 48) | KVSNRFSGVPDR (SEQ ID NO: 49) | MQGSHVP RT (SEQ ID NO: 50) | SGYTFTSYHMH (SEQ ID NO: 51) | WIYPGDGSTQYNEKFK G (SEQ ID NO: 52) | EGTYYAMDY (SEQ ID NO: 53) |
| HLA-A*03 CDRs | | | | | |
| RASQSISSYLN (SEQ ID NO: 638) | AASSLQS (SEQ ID NO: 645) | QQSYSTP LT (SEQ ID NO: 650) | SYGIS (SEQ ID NO: 657) | WISAYNGNTNYAQKLQ G (SEQ ID NO: 676) | ERVSQRGAFD I (SEQ ID NO: 693) |

TABLE 6-continued

CDRs corresponding to HLA antigen binding domains CDR-H3

| CDR-L1 | CDR-L2 | CDR-L3 | CDR-H1 | CDR-H2 | CDR-H3 |
|---|---|---|---|---|---|
| RASQSISSYLN (SEQ ID NO: 638) | AASSLQS (SEQ ID NO: 645) | QQSYSTPLT (SEQ ID NO: 650) | SYSMN (SEQ ID NO: 658) | YISSSSTIYYADSVKG (SEQ ID NO: 677) | GNPDKDPFDY (SEQ ID NO: 694) |
| RASQSISSYLN (SEQ ID NO: 638) | AASSLQS (SEQ ID NO: 645) | QQSYSTPLT (SEQ ID NO: 650) | SGSYYWS (SEQ ID NO: 659) | YIYYSGSTNYNPSLKS (SEQ ID NO: 678) | DFYCTNWYFDL (SEQ ID NO: 695) |
| RASQSISSYLN (SEQ ID NO: 638) | AASSLQS (SEQ ID NO: 645) | QQSYSTPLT (SEQ ID NO: 650) | SYYWS (SEQ ID NO: 660) | YIYYSGSTNYNPSLKS (SEQ ID NO: 678) | ESSSGSYWYFDL (SEQ ID NO: 696) |
| RASQSISSYLN (SEQ ID NO: 638) | AASSLQS (SEQ ID NO: 645) | QQSYSTPLT (SEQ ID NO: 650) | SYWIG (SEQ ID NO: 661) | IIYPGDSDTRYSPSFQG (SEQ ID NO: 679) | DSGYKYNLYYYYYYMDV (SEQ ID NO: 697) |
| ASSTGAVTSGYYPN (SEQ ID NO: 639) | STSNKHS (SEQ ID NO: 646) | LLYYGGAQWV (SEQ ID NO: 651) | SYGIS (SEQ ID NO: 657) | WISAYNGNTNYAQKLQG (SEQ ID NO: 676) | GGDLSHYYYMDV (SEQ ID NO: 698) |
| RASQSISSYLN (SEQ ID NO: 638) | AASSLQS (SEQ ID NO: 645) | QQSYSTPLT (SEQ ID NO: 650) | SYGIS (SEQ ID NO: 657) | WISAYNGNTNYAQKLQG (SEQ ID NO: 676) | ENRRYNSCYYFDY (SEQ ID NO: 699) |
| ASSTGAVTSGYYPN (SEQ ID NO: 639) | STSNKHS (SEQ ID NO: 646) | LLYYGGAQWV (SEQ ID NO: 651) | SYGIS (SEQ ID NO: 657) | WISAYNGNTNYAQKLQG (SEQ ID NO: 676) | GGDLSHYYYYLDV (SEQ ID NO: 700) |
| RASQSISSYLN (SEQ ID NO: 638) | AASSLQS (SEQ ID NO: 645) | QQSYSTPLT (SEQ ID NO: 650) | SNYMS (SEQ ID NO: 662) | VIYSGGSTYYADSVKG (SEQ ID NO: 680) | ATLLSLSYDAFDI (SEQ ID NO: 701) |
| ASSTGAVTSGYYPN (SEQ ID NO: 639) | STSNKHS (SEQ ID NO: 646) | LLYYGGAQWV (SEQ ID NO: 651) | SYGIS (SEQ ID NO: 657) | WISAYNGNTNYAQKLQG (SEQ ID NO: 676) | GGDLSHYYYMDV (SEQ ID NO: 702) |
| RASQSISSYLN (SEQ ID NO: 638) | AASSLQS (SEQ ID NO: 645) | QQSYSTPLT (SEQ ID NO: 650) | SYWIG (SEQ ID NO: 661) | IIYPGDSDTRYSPSFQG (SEQ ID NO: 679) | ERDRWFDP (SEQ ID NO: 703) |
| TGTSSDVGGYNYVS (SEQ ID NO: 640) | EVSKRPS (SEQ ID NO: 647) | SSYAGSNNWV (SEQ ID NO: 652) | SYGIS (SEQ ID NO: 657) | WISAYNGNTNYAQKLQG (SEQ ID NO: 676) | ETPPSLGAFDI (SEQ ID NO: 704) |
| SGSSSNIGSNTVN (SEQ ID NO: 641) | SNNQRPS (SEQ ID NO: 648) | AAWDDSLN (SEQ ID NO: 653) | SSSYYWG (SEQ ID NO: 663) | SIYYSGSTYYNPSLKS (SEQ ID NO: 681) | EAYCLSDSYWYFDL (SEQ ID NO: 705) |
| RASQSISSYLN (SEQ ID NO: 638) | AASSLQS (SEQ ID NO: 645) | QQSYSTPLT (SEQ ID NO: 650) | SGGYYWS (SEQ ID NO: 664) | YIYYSGSTYYNPSLKS (SEQ ID NO: 682) | ESWKYFYPRGYMDV (SEQ ID NO: 706) |
| HLA-B*07 CDRs | | | | | |
| RASENIYSNLA (SEQ ID NO: 642) | AATYLPD (SEQ ID NO: 649) | QHFWVTPYT (SEQ ID NO: 654) | SGYSWH (SEQ ID NO: 665) | YIHFSGSTHYHPSLKS (SEQ ID NO: 683) | GGVVSHYAMDC (SEQ ID NO: 707) |
| HLA-C*07 CDRs | | | | | |
| RASQSISSYLN (SEQ ID NO: 638) | AASSLQS (SEQ ID NO: 645) | QQSYSTPLT (SEQ ID NO: 650) | SYAMS (SEQ ID NO: 668) | AISGSGGSTYYADSVKG (SEQ ID NO: 686) | SFDWFDP (SEQ ID NO: 708) |
| RASQSISSYLN (SEQ ID NO: 638) | AASSLQS (SEQ ID NO: 645) | QQSYSTPLT (SEQ ID NO: 650) | SGGYYWS (SEQ ID NO: 664) | YIYYSGSTYYNPSLKS (SEQ ID NO: 682) | ERSISPYYYYMDV (SEQ ID NO: 709) |
| SGSSSNIGSNTVN (SEQ ID NO: 641) | SNNQRPS (SEQ ID NO: 648) | AAWDDSLN (SEQ ID NO: 653) | SSSYYWG (SEQ ID NO: 663) | SIYYSGSTYYNPSLKS (SEQ ID NO: 681) | DSVIWYWFDP (SEQ ID NO: 710) |

TABLE 6-continued

CDRs corresponding to HLA antigen binding domains CDR-H3

| CDR-L1 | CDR-L2 | CDR-L3 | CDR-H1 | CDR-H2 | CDR-H3 |
|---|---|---|---|---|---|
| RASQSISSYLN (SEQ ID NO: 638) | AASSLQS (SEQ ID NO: 645) | QQSYSTPLT (SEQ ID NO: 650) | SGGYYWS (SEQ ID NO: 664) | YIYYSGSTYYNPSLKS (SEQ ID NO: 682) | EEILPRLSYYYYMDV (SEQ ID NO: 711) |
| RASQSISSYLN (SEQ ID NO: 638) | AASSLQS (SEQ ID NO: 645) | QQSYSTPLT (SEQ ID NO: 650) | SYAMN (SEQ ID NO: 669) | WINTNTGNPTYAQGFTG (SEQ ID NO: 687) | GGRAHSSWYFDL (SEQ ID NO: 712) |
| RASQSISSYLN (SEQ ID NO: 638) | AASSLQS (SEQ ID NO: 645) | QQSYSTPLT (SEQ ID NO: 650) | SGGYYWS (SEQ ID NO: 664) | YIYYSGSTYYNPSLKS (SEQ ID NO: 682) | DRIKILPRLGYYYYMDV (SEQ ID NO: 713) |
| RASQSISSYLN (SEQ ID NO: 638) | AASSLQS (SEQ ID NO: 645) | QQSYSTPLT (SEQ ID NO: 650) | SGGYYWS (SEQ ID NO: 664) | YIYYSGSTYYNPSLKS (SEQ ID NO: 682) | DTVIHYYYYMDV (SEQ ID NO: 714) |
| RASQSISSYLN (SEQ ID NO: 638) | AASSLQS (SEQ ID NO: 645) | QQSYSTPLT (SEQ ID NO: 650) | SGGYYWS (SEQ ID NO: 664) | YIYYSGSTYYNPSLKS (SEQ ID NO: 682) | DVIVEVFLSYYYYMDV (SEQ ID NO: 715) |
| RASQSISSYLN (SEQ ID NO: 638) | AASSLQS (SEQ ID NO: 645) | QQSYSTPLT (SEQ ID NO: 650) | SGGYYWS (SEQ ID NO: 664) | YIYYSGSTYYNPSLKS (SEQ ID NO: 682) | DIFIHYYYYMDV (SEQ ID NO: 716) |
| RASQSISSYLN (SEQ ID NO: 638) | AASSLQS (SEQ ID NO: 645) | QQSYSTPLT (SEQ ID NO: 650) | SYSMN (SEQ ID NO: 658) | YISSSSSTIYYADSVKG (SEQ ID NO: 677) | DGTFYSYSPYYFDY (SEQ ID NO: 717) |
| RASQSISSYLN (SEQ ID NO: 638) | AASSLQS (SEQ ID NO: 645) | QQSYSTPLT (SEQ ID NO: 650) | SGGYYWS (SEQ ID NO: 664) | YIYYSGSTYYNPSLKS (SEQ ID NO: 682) | EWIKILPRLGYYYYMDV (SEQ ID NO: 718) |
| RASQSISSYLN (SEQ ID NO: 638) | AASSLQS (SEQ ID NO: 645) | QQSYSTPLT (SEQ ID NO: 650) | SGGYYWS (SEQ ID NO: 664) | YIYYSGSTYYNPSLKS (SEQ ID NO: 682) | DRSLYYYYMDV (SEQ ID NO: 719) |
| RASQSISSYLN (SEQ ID NO: 638) | AASSLQS (SEQ ID NO: 645) | QQSYSTPLT (SEQ ID NO: 650) | SGGYYWS (SEQ ID NO: 664) | YIYYSGSTYYNPSLKS (SEQ ID NO: 682) | DKILAPNYYYYMDV (SEQ ID NO: 720) |
| RASQSISSYLN (SEQ ID NO: 638) | AASSLQS (SEQ ID NO: 645) | QQSYSTPLT (SEQ ID NO: 650) | SGGYYWS (SEQ ID NO: 664) | YIYYSGSTYYNPSLKS (SEQ ID NO: 682) | EKSWKYFYYYYYMDV (SEQ ID NO: 721) |
| RASQSISSYLN (SEQ ID NO: 638) | AASSLQS (SEQ ID NO: 645) | QQSYSTPLT (SEQ ID NO: 650) | SGGYYWS (SEQ ID NO: 664) | YIYYSGSTYYNPSLKS (SEQ ID NO: 682) | ENTSTIPYYYYYMDV (SEQ ID NO: 722) |
| RASQSISSYLN (SEQ ID NO: 638) | AASSLQS (SEQ ID NO: 645) | QQSYSTPLT (SEQ ID NO: 650) | SGGYYWS (SEQ ID NO: 664) | YIYYSGSTYYNPSLKS (SEQ ID NO: 682) | EDVDKNTSTIYYYYYMDV (SEQ ID NO: 723) |
| RASQGISSALA (SEQ ID NO: 643) | DASSLES (SEQ ID NO: 55) | QQFNSYPLT (SEQ ID NO: 60) | DYYMS (SEQ ID NO: 670) | YISSSGSTIYYADSVKG (SEQ ID NO: 688) | DGGDIVSSSAIYWYFDL (SEQ ID NO: 724) |
| RASQSISSYLN (SEQ ID NO: 638) | AASSLQS (SEQ ID NO: 645) | QQSYSTPLT (SEQ ID NO: 650) | SGGYYWS (SEQ ID NO: 664) | YIYYSGSTYYNPSLKS (SEQ ID NO: 682) | DLILPPYYYYMDV (SEQ ID NO: 725) |
| RASQSISSYLN (SEQ ID NO: 638) | AASSLQS (SEQ ID NO: 645) | QQSYSTPLT (SEQ ID NO: 650) | SGGYYWS (SEQ ID NO: 664) | YIYYSGSTYYNPSLKS (SEQ ID NO: 682) | ETWIKILPRYYYYYYMDV (SEQ ID NO: 726) |
| RASQSISSYLN (SEQ ID NO: 638) | AASSLQS (SEQ ID NO: 645) | QQSYSTPLT (SEQ ID NO: 650) | SGGYYWS (SEQ ID NO: 664) | YIYYSGSTYYNPSLKS (SEQ ID NO: 682) | DLSRYYYYMDV (SEQ ID NO: 727) |
| RASQGISSWLA (SEQ ID NO: 644) | AASSLQS (SEQ ID NO: 645) | QQYNSYPLT (SEQ ID NO: 655) | SYSMN (SEQ ID NO: 658) | YIYYYYYTIYYADSVKG (SEQ ID NO: 677) | EHIVLCFDY (SEQ ID NO: 728) |
| RASQSISSYLN (SEQ ID NO: 638) | AASSLQS (SEQ ID NO: 645) | QQSYSTPLT (SEQ ID NO: 650) | SGGYYWS (SEQ ID NO: 664) | YIYYSGSTYYNPSLKS (SEQ ID NO: 682) | DKILPRPYYYYMDV (SEQ ID NO: 729) |

TABLE 6-continued

CDRs corresponding to HLA antigen binding domains CDR-H3

| CDR-L1 | CDR-L2 | CDR-L3 | CDR-H1 | CDR-H2 | CDR-H3 |
| --- | --- | --- | --- | --- | --- |
| TGTSSDVGGYNYVS (SEQ ID NO: 640) | EVSKRPS (SEQ ID NO: 647) | SSYAGSN N (SEQ ID NO: 652) | SYGIS (SEQ ID NO: 657) | WISAYNGNTNYAQKLQ G (SEQ ID NO: 676) | GSNEYFQH (SEQ ID NO: 730) |
| RASQSISSYLN (SEQ ID NO: 638) | AASSLQS (SEQ ID NO: 645) | QQSYSTP LT (SEQ ID NO: 650) | SGGYYWS (SEQ ID NO: 664) | WINTNTGNPTYAQGFT G (SEQ ID NO: 687) | GTSYWYFDL (SEQ ID NO: 731) |
| RASQSISSYLN (SEQ ID NO: 638) | AASSLQS (SEQ ID NO: 645) | QQSYSTP LT (SEQ ID NO: 650) | SGGYYWS (SEQ ID NO: 664) | YIYYSGSTYYNPSLKS (SEQ ID NO: 682) | EEIVEVFYYYY MDV (SEQ ID NO: 732) |
| RASQSISSYLN (SEQ ID NO: 638) | AASSLQS (SEQ ID NO: 645) | QQSYSTP LT (SEQ ID NO: 650) | SYAMS (SEQ ID NO: 668) | AISGSGGSTYYADSVK G (SEQ ID NO: 686) | VDDYYFDY (SEQ ID NO: 733) |
| RASQSISSYLN (SEQ ID NO: 638) | AASSLQS (SEQ ID NO: 645) | QQSYSTP LT (SEQ ID NO: 650) | SYWMH (SEQ ID NO: 667) | RINSDGSSTSYADSVK G (SEQ ID NO: 685) | STNILLSYTKA FDI (SEQ ID NO: 734) |
| RASQSISSYLN (SEQ ID NO: 638) | AASSLQS (SEQ ID NO: 645) | QQSYSTP LT (SEQ ID NO: 650) | SGGYYWS (SEQ ID NO: 664) | YIYYSGSTYYNPSLKS (SEQ ID NO: 682) | DKTYYYYYMD V (SEQ ID NO: 735) |
| RASQSISSYLN (SEQ ID NO: 638) | AASSLQS (SEQ ID NO: 645) | QQSYSTP LT (SEQ ID NO: 650) | SGGYYWS (SEQ ID NO: 664) | YIYYSGSTYYNPSLKS (SEQ ID NO: 682) | EKYFHDKYFHD YYYYYMDV (SEQ ID NO: 736) |
| RASQSISSYLN (SEQ ID NO: 638) | AASSLQS (SEQ ID NO: 645) | QQSYSTP LT (SEQ ID NO: 650) | SGGYYWS (SEQ ID NO: 664) | YIYYSGSTYYNPSLKS (SEQ ID NO: 682) | DTSVYYYYMD V (SEQ ID NO: 737) |
| RASQSISSYLN (SEQ ID NO: 638) | AASSLQS (SEQ ID NO: 645) | QQSYSTP LT (SEQ ID NO: 650) | SGGYYWS (SEQ ID NO: 664) | YIYYSGSTYYNPSLKS (SEQ ID NO: 682) | EKILPYYYYYY MDV (SEQ ID NO: 738) |
| SGSSSNIGSNTVN (SEQ ID NO: 641) | SNNQRPS (SEQ ID NO: 648) | AAWDDSL NGWV (SEQ ID NO: 653) | SYSMN (SEQ ID NO: 658) | YISSSSSTIYYADSVK G (SEQ ID NO: 677) | QWIYIYINPRG FIFLHDAFDI (SEQ ID NO: 739) |
| RASQSISSYLN (SEQ ID NO: 638) | AASSLQS (SEQ ID NO: 645) | QQSYSTP LT (SEQ ID NO: 650) | SNSAAWN (SEQ ID NO: 671) | RTYYRSKWYNDYAVSV KS (SEQ ID NO: 689) | EDVDFHHDAFD I (SEQ ID NO: 740) |
| RASQSISSYLN (SEQ ID NO: 638) | AASSLQS (SEQ ID NO: 645) | QQSYSTP LT (SEQ ID NO: 650) | SGGYYWS (SEQ ID NO: 664) | YIYYSGSTYYNPSLKS (SEQ ID NO: 682) | EGVDKNTSTIY YYYYYMDV (SEQ ID NO: 741) |
| RASQGISSWLA (SEQ ID NO: 644) | AASSLQS (SEQ ID NO: 645) | QQYNSYP LT (SEQ ID NO: 655) | SYSMN (SEQ ID NO: 658) | YISSSSSTIYYADSVK G (SEQ ID NO: 677) | DRRGYFDL (SEQ ID NO: 742) |
| RASQSISSYLN (SEQ ID NO: 638) | AASSLQS (SEQ ID NO: 645) | QQSYSTP LT (SEQ ID NO: 650) | DYYMH (SEQ ID NO: 672) | LVDPEDGETIYAEKFQ G (SEQ ID NO: 690) | GIHVDIRSMED WFDP (SEQ ID NO: 743) |
| RASQSISSYLN (SEQ ID NO: 638) | AASSLQS (SEQ ID NO: 645) | QQSYSTP LT (SEQ ID NO: 650) | SGGYYWS (SEQ ID NO: 664) | YIYYSGSTYYNPSLKS (SEQ ID NO: 682) | DIGTSYYYYMD V (SEQ ID NO: 744) |
| RASQSISSYLN (SEQ ID NO: 638) | AASSLQS (SEQ ID NO: 645) | QQSYSTP LT (SEQ ID NO: 650) | SGGYYWS (SEQ ID NO: 664) | YIYYSGSTYYNPSLKS (SEQ ID NO: 682) | EVVEVFLYYYY YMDV (SEQ ID NO: 745) |
| RASQSISSYLN (SEQ ID NO: 638) | AASSLQS (SEQ ID NO: 645) | QQSYSTP LT (SEQ ID NO: 650) | SGGYYWS (SEQ ID NO: 664) | YIYYSGSTYYNPSLKS (SEQ ID NO: 682) | DLYYYYYYMD V (SEQ ID NO: 746) |
| RASQSISSYLN (SEQ ID NO: 638) | AASSLQS (SEQ ID NO: 645) | QQSYSTP LT (SEQ ID NO: 650) | SGGYYWS (SEQ ID NO: 664) | YIYYSGSTYYNPSLKS (SEQ ID NO: 682) | ESWKYFPRGS IFIHYYYYMDV (SEQ ID NO: 747) |

TABLE 6-continued

CDRs corresponding to HLA antigen binding domains CDR-H3

| CDR-L1 | CDR-L2 | CDR-L3 | CDR-H1 | CDR-H2 | CDR-H3 |
|---|---|---|---|---|---|
| RASQSISSYLN (SEQ ID NO: 638) | AASSLQS (SEQ ID NO: 645) | QQSYSTP LT (SEQ ID NO: 650) | SGGYYWS (SEQ ID NO: 664) | YIYYSGSTYYNPSLKS (SEQ ID NO: 682) | DRIVEVFYYYY MDV (SEQ ID NO: 748) |
| RASQSISSYLN (SEQ ID NO: 638) | AASSLQS (SEQ ID NO: 645) | QQSYSTP LT (SEQ ID NO: 650) | SGGYYWS (SEQ ID NO: 664) | YIYYSGSTYYNPSLKS (SEQ ID NO: 682) | EKYFHDWLYYY YYMDV (SEQ ID NO: 749) |
| RASQSISSYLN (SEQ ID NO: 638) | AASSLQS (SEQ ID NO: 645) | QQSYSTP LT (SEQ ID NO: 650) | SGGYYWS (SEQ ID NO: 664) | YIYYSGSTYYNPSLKS (SEQ ID NO: 682) | DLVDKNTSYYY YYMDV (SEQ ID NO: 750) |
| TGTSSDVGGYNYVS (SEQ ID NO: 640) | EVSKRPS (SEQ ID NO: 647) | SSYAGSN NWV (SEQ ID NO: 652) | SYGIS (SEQ ID NO: 657) | WISAYNGNTNYAQKLQ G (SEQ ID NO: 676) | VQNEYFQH (SEQ ID NO: 751) |
| RASQGISSWLA (SEQ ID NO: 644) | AASSLQS (SEQ ID NO: 645) | QQANSFP LT (SEQ ID NO: 656) | DYYMS (SEQ ID NO: 670) | YISSSGSTIYYADSVK G (SEQ ID NO: 688) | ANWFDP (SEQ ID NO: 752) |
| | | HLA-A*01 CDRs | | | |
| ASSTGAVTSGYYPN (SEQ ID NO: 639) | STSNKHS (SEQ DI NO: 646) | LLYYGGA QWV (SEQ ID NO: 651) | SYGIS (SEQ ID NO: 657) | WISAYNGNTNYAQKLQ G (SEQ ID NO: 676) | GGWTAWYYYMD V (SEQ ID NO: 753) |
| SGSSSNIGSNTVN (SEQ ID NO: 641) | SNNQRPS (SEQ ID NO: 648) | AAWDDSL NGWV (SEQ ID NO: 653) | SYSMN (SEQ ID NO: 658) | YISSSSSTIYYADSVK G (SEQ ID NO: 677) | AKYYYMDV (SEQ ID NO: 754) |
| RASQSISSYLN (SEQ ID NO: 638) | AASSLQS (SEQ ID NO: 645) | QQSYSTP LT (SEQ ID NO: 650) | SGGYYWS (SEQ ID NO: 664) | YIYYSGSTYYNPSLKS (SEQ ID NO: 682) | DQVDKNTYYYY MDV (SEQ ID NO: 755) |
| RASQGISSWLA (SEQ ID NO: 644) | AASSLQS (SEQ ID NO: 645) | QQANSFP LT (SEQ ID NO: 656) | DYYMS (SEQ ID NO: 670) | YISSSGSTIYYADSVK G (SEQ ID NO: 688) | ACQLAEYFQH (SEQ ID NO: 756) |
| RASQSISSYLN (SEQ ID NO: 638) | AASSLQS (SEQ ID NO: 645) | QQSYSTP LT (SEQ ID NO: 650) | SGGYYWS (SEQ ID NO: 664) | YIYYSGSTYYNPSLKS (SEQ ID NO: 682) | DRVDKNTSYYY MDV (SEQ ID NO: 757) |
| RASQSISSYLN (SEQ ID NO: 638) | AASSLQS (SEQ ID NO: 645) | QQSYSTP LT (SEQ ID NO: 650) | SSNWWG (SEQ ID NO: 673) | YIYYSGSTYYNPSLKS (SEQ ID NO: 682) | RVQLKLVHWFD P (SEQ ID NO: 758) |
| RASQSISSYLN (SEQ ID NO: 638) | AASSLQS (SEQ ID NO: 645) | QQSYSTP LT (SEQ ID NO: 650) | SYDIN (SEQ ID NO: 674) | WMNPNSGNTGYAQKFQ G (SEQ ID NO: 691) | YYDYVTVFYFQ H (SEQ ID NO: 759) |
| RASQSISSYLN (SEQ ID NO: 638) | AASSLQS (SEQ ID NO: 645) | QQSYSTP LT (SEQ ID NO: 650) | SGGYSWS (SEQ ID NO: 675) | YIYHSGSTYYNPSLKS (SEQ ID NO: 692) | ESYPSFYAFDI (SEQ ID NO: 760) |
| RASQSISSYLN (SEQ ID NO: 638) | AASSLQS (SEQ ID NO: 645) | QQSYSTP LT (SEQ ID NO: 650) | TSGVGVG (SEQ ID NO: 666) | LIYWNDDKRYSPSLKS (SEQ ID NO: 684) | SNMWSYSLNDY YFDY (SEQ ID NO: 761) |

In some embodiments, the non-target antigen comprises HLA-A. In some embodiments, the ligand binding domain of the second, inhibitory receptor comprises an HLA-A*01, HLA-A*02, HLA-A*03 or HLA-A*11 ligand binding domain comprising CDR sequences as set forth in Table 6 or Table 7.

In some embodiments, the non-target antigen comprises HLA-B. In some embodiments, the ligand binding domain of the second, inhibitory receptor comprises an HLA-B*07 ligand binding domain comprising CDR sequences as set forth in Table 6.

In some embodiments, the non-target antigen comprises HLA-C. In some embodiments, the ligand binding domain of the second, inhibitory receptors comprises an HLA-C*07 ligand binding domain comprising CDR sequences as set forth in Table 6.

In some embodiments, the extracellular ligand binding domain of the second receptor specifically binds an allelic variant of an HLA-A, HLA-B, or HLA-C protein. In some embodiments, the extracellular ligand binding domain of the second receptor specifically binds to HLA-A*01, HLA-A*02, HLA-A*03, HLA-A*11, HLA-B*07, or HLA-C*07.

In some embodiments, the extracellular ligand binding domain of the second receptor specifically binds to HLA-A*01. In some embodiments, the extracellular ligand binding domain of the second receptor comprises HLA-A*01 complementarity determining regions (CDRs) CDR-L1, CDR-L2, CDR-L3, CDR-H1, CDR-H2, CDR-H3 as disclosed Table 6; or CDR sequences having at most 1, 2, or 3 substitutions, deletions, or insertions relative to the HLA-A*01 CDRs of Table 6.

In some embodiments, the extracellular ligand binding domain of the second receptor specifically binds to HLA-A*02. In some embodiments, the extracellular ligand binding domain of the second receptor comprises HLA-A*02 complementarity determining regions (CDRs) CDR-L1, CDR-L2, CDR-L3, CDR-H1, CDR-H2, CDR-H3 as disclosed Table 6; or CDR sequences having at most 1, 2, or 3 substitutions, deletions, or insertions relative to the HLA-A*02 CDRs of Table 6.

In some embodiments, the extracellular ligand binding domain of the second receptor comprises complementarity determining regions (CDRs) CDR-L1, CDR-L2, CDR-L3, CDR-H1, CDR-H2, CDR-H3 of SEQ ID NOS: 103-108 or of SEQ ID NOS: 109-114; or CDR sequences having at most 1, 2, or 3 substitutions, deletions, or insertion relative to the CDRs of SEQ ID NOS: 103-108 or SEQ ID NOS: 109-114.

In some embodiments, the extracellular ligand binding domain of the second receptor specifically binds to HLA-A*03. In some embodiments, the extracellular ligand binding domain of the second receptor comprises HLA-A*03 complementarity determining regions (CDRs) CDR-L1, CDR-L2, CDR-L3, CDR-H1, CDR-H2, CDR-H3 as disclosed Table 6; or CDR sequences having at most 1, 2, or 3 substitutions, deletions, or insertions relative to the HLA-A*03 CDRs of Table 6.

In some embodiments, the extracellular ligand binding domain of the second receptor specifically binds to HLA-A*11. In some embodiments, the extracellular ligand binding domain of the second receptor comprises HLA-A*11 complementarity determining regions (CDRs) CDR-L1, CDR-L2, CDR-L3, CDR-H1, CDR-H2, CDR-H3 as disclosed Table 7; or CDR sequences having at most 1, 2, or 3 substitutions, deletions, or insertions relative to the HLA-A*11 CDRs of Table 7.

In some embodiments, the extracellular ligand binding domain of the second receptor specifically binds to HLA-B*07. In some embodiments, the extracellular ligand binding domain of the second receptor comprises HLA-B*07 complementarity determining regions (CDRs) CDR-L1, CDR-L2, CDR-L3, CDR-H1, CDR-H2, CDR-H3 as disclosed Table 6; or CDR sequences having at most 1, 2, or 3 substitutions, deletions, or insertions relative to the HLA-B*07 CDRs of Table 6.

In some embodiments, the extracellular ligand binding domain of the second receptor specifically binds to HLA-C*07. In some embodiments, the extracellular ligand binding domain of the second receptor comprises HLA-C*07 complementarity determining regions (CDRs) CDR-L1, CDR-L2, CDR-L3, CDR-H1, CDR-H2, CDR-H3 as disclosed Table 6; or CDR sequences having at most 1, 2, or 3 substitutions, deletions, or insertions relative to the HLA-C*07 CDRs of Table 6.

In further embodiments of any of the ligand binding domains, each CDR sequence may have 1, 2, 3 or more substitutions, insertions, or deletions. CDR sequences may tolerate substitutions, deletions, or insertions. Using sequence alignment tools, routine experimentation, and known assays, those of skill in the art may generate and test variant sequences having 1, 2, 3, or more substitutions, insertions, or deletions in CDR sequences without undue experimentation.

In some embodiments, the non-target antigen comprising HLA-A*02, and the ligand binding domain of the second receptor comprises an HLA-A*02 ligand binding domain. In some embodiments, the ligand binding domain binds HLA-A*02 independent of the peptide in a pMHC complex comprising HLA-A*02. In some embodiments, the HLA-A*02 ligand binding domain comprises an scFv domain. In some embodiments, the HLA-A*02 ligand binding domain comprises a sequence of any one of SEQ ID NOs: 30-41. In some embodiments, the HLA-A*02 ligand binding domain comprises a sequence at least 90%, at least 95%, at least 97% or at least 99% identical to a sequence of any one of SEQ ID NOs: 30-41.

In some embodiments, the non-target antigen comprises HLA-A*02, and the extracellular ligand binding domain of the second receptor comprises a sequence of SEQ ID NO: 30, or a sequence having at least 90%, at least 95%, at least 97%, or at least 99% identity thereto. In some embodiments, the non-target antigen comprises HLA-A*02, and the extracellular ligand binding domain of the second receptor comprises a sequence of SEQ ID NO: 30.

In some embodiments, the non-target antigen comprises HLA-A*02, and the extracellular ligand binding domain of the second receptor comprises a VL comprising a sequence of DVLMTQTPLSLPVSLGDQASISCRSSQSIVHSNGN-TYLEWYLQKPGQSPKLLIYKVSN RFSGVPDRFSGSGSGTDFTLKISRVEAE-DLGVYYCFQGSHVPRTSGGGTKLEIK (SEQ ID NO: 762), or a sequence having at least 90%, at least 95%, at least 97%, or at least 99% identity thereto. In some embodiments, the extracellular ligand binding domain of the second receptor comprises a VH comprising a sequence of QVQLQQSG-PELVKPGASVRISCKASGYTFTSYHIHWVKQRPGQ-GLEWIGWIYPGNV NTEYNEKFKGKATLTADKSSSTAYMHLSSLTSED-SAVYFCAREEITYAMDYWGQGT SVTVSS (SEQ ID NO: 763), or a sequence having at least 90%, at least 95%, at least 97%, or at least 99% identity thereto. In some embodiments, the VH and VL are separated by a linker, for example GGGGSGGGGSGGGGSGG (SEQ ID NO: 152). In some embodiments, the VH and VL are ordered, from N to C terminal, VH, linker and VL. In some embodiments, the VH and VL are ordered, from N to C terminal, VL, linker and VH.

In some embodiments, the HLA-A*02 scFv comprises the complementarity determined regions (CDRs) of any one of SEQ ID NOS: 42-53. In some embodiments, the scFv comprises a sequence at least 95% identical to any one of SEQ ID NOS: 42-53. In some embodiments, the scFv comprises a sequence identical to any one of SEQ ID NOS: 42-53. In some embodiments, the heavy chain of the antigen binding domain comprises the heavy chain CDRs of any one of SEQ ID NOS: 42-53, and wherein the light chain of the antigen binding domain comprises the light chain CDRs of any one of SEQ ID NOS: 42-53. In some embodiments, the HLA-A*02 antigen binding domain comprises a heavy chain and a light chain, and the heavy chain comprises CDRs selected from SEQ ID NOs: 45-47 and 51-53 and the light chain comprises CDRs selected from SEQ ID NOs: 42-44 and 48-50.

In some embodiments, the HLA-A*02 antigen binding domain comprises a heavy chain and a light chain, and the heavy chain comprises a sequence at least 95% identical to the heavy chain portion of any one of SEQ ID NOS: 30-41, and the light chain comprises a sequence at least 95% identical to the light chain portion of any one of SEQ ID NOS: 30-41.

In some embodiments, the heavy chain comprises a sequence identical to the heavy chain portion of any one of SEQ ID NOS: 30-41, and wherein the light chain of comprises a sequence identical to the light chain portion of any one of SEQ ID NOS: 30-41.

In some embodiments, the non-target antigen comprises HLA-A*01, and the extracellular ligand binding domain of the second receptor comprises an HLA-A*01 ligand binding domain. In some embodiments, the HLA-A*01 ligand binding domain comprises an scFv domain comprising a sequence selected from the group of sequences set forth in Table 5, or a sequence at least 90%, at least 95% or at least 99% identical to thereto. In some embodiments, the HLA-A*01 scFv comprises HLA-A*1 CDR sequences as set forth in Table 6.

In some embodiments, the non-target antigen comprises HLA-A*03, and the extracellular ligand binding domain of the second receptor comprises an HLA-A*03 ligand binding domain. In some embodiments, the HLA-A*03 ligand binding domain comprises an scFv domain comprising a sequence selected from the group of sequences set forth in Table 5, or a sequence at least 90%, at least 95% or at least 99% identical to thereto. In some embodiments, the HLA-A*03 scFv comprises HLA-A*03 CDR sequences as set forth in Table 6.

In some embodiments, the non-target antigen comprises HLA-A*11, and the extracellular ligand binding domain of the second receptor comprises an HLA-A*11 ligand binding domain. In some embodiments, the HLA-A*11 ligand binding domain comprises an scFv domain comprising a sequence selected from the group of sequences set forth in Table 5, or a sequence at least 90%, at least 95% or at least 99% identical to thereto. In some embodiments, the HLA-A*11 scFv comprises HLA-A*11 CDR sequences as set forth in Table 7.

In some embodiments, the non-target antigen comprises HLA-B*07, and the extracellular ligand binding domain of the second receptor comprises an HLA-B*07 ligand binding domain. In some embodiments, the HLA-B*07 ligand binding domain comprises an scFv domain comprising a sequence selected from the group of sequences set forth in Table 5, or a sequence at least 90%, at least 95% or at least 99% identical to thereto. In some embodiments, the HLA-B*07 scFv comprises HLA-B*07 CDR sequences as set forth in Table 6.

In some embodiments, the non-target antigen comprises HLA-C*07, and the extracellular ligand binding domain of the second receptor comprises an HLA-C*07 ligand binding domain. In some embodiments, the HLA-C*07 ligand binding domain comprises an scFv domain comprising a sequence selected from the group of sequences set forth in Table 5, or a sequence at least 90%, at least 95% or at least 99% identical to thereto. In some embodiments, the HLA-C*07 scFv comprises HLA-C*07 CDR sequences as set forth in Table 6.

In some embodiments, the non-target antigen comprises HLA-A*11. Various single variable domains known in the art or disclosed herein that bind to and recognize HLA-A*11 are suitable for use in embodiments. Such scFvs include, for example and without limitation, the following mouse and humanized scFv antibodies that bind HLA-A*11 in a peptide-independent way shown in Table 5 supra.

Exemplary heavy chain and light chain CDRs (CDR-H1, CDR-H2 and CDR-H3, or CDR-L1, CDR-L2 and CDR-L3, respectively) for HLA-A*11 ligand binding domains are shown in Table 7 below. Any of the VH CDRs in Table 7 and may be combined with the VL CDRs disclosed in Table 7.

TABLE 7

Exemplary anti-HLA-A*11 CDR Sequences

| CDR H1 | CDR H2 | CDR H3 |
|---|---|---|
| SGGYYWS (SEQ ID NO: 92) | YIYYSGSTYYNPSLKS (SEQ ID NO: 97) | HYYYYYMDV (SEQ ID NO: 105) |
| TSGVGVG (SEQ ID NO: 93) | LIYWNDDKRYSPSLKS (SEQ ID NO: 98) | KTTSFYFDY (SEQ ID NO: 106) |
| SGGYYWS (SEQ ID NO: 92) | YIYYSGSTYYNPSLKS (SEQ ID NO: 97) | HYYYYMDV (SEQ ID NO: 104) |
| SYWMH (SEQ ID NO: 96) | RINSDGSSTSY-ADSVKG (SEQ ID NO: 101) | GVLLYNWFDP (SEQ ID NO: 110) |
| SGGYYWS (SEQ ID NO: 92) | YIYYSGSTYYNPSLKS (SEQ ID NO: 97) | HYYYYLDV (SEQ ID NO: 103) |
| SYDMH (SEQ ID NO: 95) | AIGTAGDTYYPGSVKG (SEQ ID NO: 100) | DLPGSYWYFDL (SEQ ID NO: 109) |
| SYAMH (SEQ ID NO: 94) | WINAGNGNT-KYSQKFQG (SEQ ID NO: 99) | EGNGANPDAFDI (SEQ ID NO: 108) |
| TSGVGVG (SEQ ID NO: 93) | LIYWNDDKRYSPSLKS (SEQ ID NO: 98) | RHMRLSCFDY (SEQ ID NO: 107) |
| SGGYYWS (SEQ ID NO: 92) | YIYYSGSTYYNPSLKS (SEQ ID NO: 97) | HYYYYSMDV (SEQ ID NO: 102) |
| CDR1 LC | CDR2 LC | CDR3 LC |
| RASQSISSYLN (SEQ ID NO: 111) | AASSLQS (SEQ ID NO: 112) | QQSYSTPLT (SEQ ID NO: 113) |

In some embodiments, the non-target antigen comprising HLA-A*11, and the ligand binding domain of the second receptor comprises an HLA-A*11 ligand binding domain. In some embodiments, the ligand binding domain binds HLA-A*11 independent of the peptide in a pMHC complex comprising HLA-A*11. In some embodiments, the HLA-A*11 ligand binding domain comprises an scFv domain. In some embodiments, the HLA-A*11 ligand binding domain comprises a sequence of any one of SEQ ID NOs: 114-122. In some embodiments, the HLA-A*11 ligand binding domain comprises a sequence at least 90%, at least 95% or at least 99% identical to a sequence of any one of SEQ ID NOs: 114-122.

In some embodiments, the HLA-A*11 scFv comprises the complementarity determined regions (CDRs) of any one of SEQ ID NOS: 114-122. In some embodiments, the scFv comprises a sequence at least 95% identical to any one of SEQ ID NOS: 114-122. In some embodiments, the scFv comprises a sequence identical to any one of SEQ ID NOS: 114-122. In some embodiments, the heavy chain of the antigen binding domain comprises the heavy chain CDRs of any one of SEQ ID NOS: 132-140, and wherein the light chain of the antigen binding domain comprises the light chain CDRs of SEQ ID NO: 141. In some embodiments, the HLA-A*11 antigen binding domain comprises a heavy chain and a light chain, and the heavy chain comprises one, two, or three CDRs selected from SEQ ID NOs: 92-110 and the light chain comprises one, two or three CDRs selected from SEQ ID NOs: 111-113.

Exemplary heavy and light chain sequences for HLA-A*11 antigen binding domains are provided in Table 8, below. In some embodiments, the HLA-A*11 antigen binding domain comprises a heavy chain and a light chain, and the heavy chain comprises a sequence at least 95% identical to the heavy chain portion of any one of SEQ ID NOS: 132-140, and the light chain comprises a sequence at least 95% identical to the light chain portion of SEQ ID NO: 141.

In some embodiments, the heavy chain comprises a sequence identical to the heavy chain portion of any one of SEQ ID NOS: 114-122, and wherein the light chain of comprises a sequence identical to the light chain portion of any one of SEQ ID NOS: 114-122.

TABLE 8

Exemplary anti-HLA-A*11 heavy and light chain sequences

| scFv | Protein Sequence | DNA Sequence |
|---|---|---|
| | Heavy Chain Sequences | |
| 9 | QVQLQESGPGLVKPSQTLSLTCT VSGGSIS<u>SGGYYWS</u>WIRQPPGKG LEWIG<u>YIYYSGSTYYNPSLKSRV</u> TISVDTSKNQFSLKLSSVTAADT AVYYCAR<u>HYYYYSMDV</u>WGKGTTV TVSS (SEQ ID NO: 132) | CAGGTGCAGCTGCAGGAAAGCGGCCCTGGCCTGGTGAAACCCAGCC AGACCCTGAGCCTGACCTGCACAGTGTCCGGCGGCTCGATCAGCAG CGGCGGCTACTACTGGTCCTGGATCAGACAGCCCCCTGGCAAGGGC CTGGAATGGATCGGCTACATCTACTACAGCGGCAGCACCTACTACA ACCCCAGCCTGAAGTCCAGAGTGACCATCAGCGTGGACACCAGCAA GAACCAGTTCAGCCTGAAGCTGAGCAGCGTGACAGCCGCCGACACC GCTGTGTATTACTGTGCGAGACACTACTACTACTACTCCATGGACG TCTGGGGCAAAGGGACCACGGTCACCGTGTCCTCA (SEQ ID NO: 142) |
| 8 | QITLKESGPTLVKPTQTLTLTCT FSGFSLS<u>TSGVGVG</u>WIRQPPGKA LEWLAL<u>IYWNDDKRYSPSLKSRL</u> TITKDTSKNQVVLTMTNMDPVDT ATYYCAH<u>RHMRLSCFDY</u>WGQGTL VTVSS (SEQ ID NO: 133) | CAGATCACCCTGAAAGAGTCCGGCCCCACCCTGGTGAAACCCACCC AGACCCTGACCCTGACATGCACCTTCAGCGGCTTCAGCCTGAGCAC CTCTGGCGTGGGCGTGGGCTGGATCAGACAGCCTCCCGGCAAGGCC CTGGAATGGCTGGCCCTGATCTACTGGAACGACGACAAGCGGTACA GCCCCAGCCTGAAGTCCCGGCTGACCATCACCAAGGACACCTCGAA GAACCAGGTGGTGCTGACCATGACAAACATGGACCCCGTGGACACC GCCACATATTACTGTGCACACAGACACATGCGTTTAAGCTGTTTTG ACTACTGGGGCCAGGGAACCCTGGTCACCGTGTCCTCA (SEQ ID NO: 143) |
| 7 | QVQLVQSGAEVKKPGASVKVSCK ASGYTFT<u>SYAMH</u>WVRQAPGQRLE WMGW<u>INAGNGNTKYSQKFQ</u>GRVT ITRDTSASTAYMELSSLRSEDTA VYYCAR<u>EGNGANPDAFDI</u>WGQGT MVTVSS (SEQ ID NO: 134) | CAGGTGCAGCTGGTGCAGTCTGGCGCCGAAGTGAAGAAACCTGGCG CCTCCGTGAAGGTGTCCTGCAAGGCCAGCGGCTACACCTTCACCAG CTACGCCATGCACTGGGTTCGACAGGCCCCTGGCCAGAGACTGGAA TGGATGGGCTGGATCAACGCCGGCAACGGCAACACCAAGTACAGCC AGAAATTCCAGGGCAGAGTGACCATCACCCGGGACACCAGCGCCAG CACCGCCTACATGGAACTGAGCAGCCTGCGGAGCGAGGACACCGCT GTGTATTACTGTGCGAGAGAAGGAAATGGTGCCAACCCTGATGCTT TTGATATCTGGGGCCAAGGGACAATGGTCACCGTGTCCTCA (SEQ ID NO: 144) |
| 6 | EVQLVESGGGLVQPGGSLRLSCA ASGFTFS<u>SYDMH</u>WVRQATGKGLE WVS<u>AIGTAGDTYYPGSVKG</u>RFTI SRENAKNSLYLQMNSLRAGDTAV YYCARD<u>LPGSYWYFDL</u>WGRGTLV TVSS (SEQ ID NO: 135) | GAAGTGCAGCTGGTGGAAAGCGGCGGAGGCCTGGTGCAGCCTGGCG GCAGCCTGAGACTGTCTTGCGCCGCCAGCGGCTTCACCTTCAGCAG CTACGACATGCACTGGGTCCGCCAGGCCACCGGCAAGGGACTGGAA TGGGTGTCCGCCATCGGCACAGCCGGCGACACTTACTACCCCGGCA GCGTGAAGGGCCGGTTCACCATCAGCAGAGAGAACGCCAAGAACAG CCTGTACCTGCAGATGAACAGCCTTCGAGCCGGCGATACCGCCGTG TATTACTGTGCAAGAGATCTCCCTGGTAGCTACTGGTACTTCGATC TCTGGGGCCGTGGCACCCTGGTCACTGTGTCCTCA (SEQ ID NO: 145) |
| 5 | QVQLQESGPGLVKPSQTLSLTCT VSGGSIS<u>SGGYYWS</u>WIRQPPGKG LEWIG<u>YIYYSGSTYYNPSLKSRV</u> TISVDTSKNQFSLKLSSVTAADT AVYYCAR<u>HYYYYYLDV</u>WGKGTTV TVSS (SEQ ID NO: 136) | CAGGTGCAGCTGCAGGAAAGCGGCCCTGGCCTGGTGAAACCCAGCC AGACCCTGAGCCTGACCTGCACAGTGTCCGGCGGCTCGATCAGCAG CGGCGGCTACTACTGGTCCTGGATCAGACAGCCCCCTGGCAAGGGC CTGGAATGGATCGGCTACATCTACTACAGCGGCAGCACCTACTACA ACCCCAGCCTGAAGTCCAGAGTGACCATCAGCGTGGACACCAGCAA GAACCAGTTCAGCCTGAAGCTGAGCAGCGTGACAGCCGCCGACACC GCTGTGTATTACTGTGCGAGACACTACTACTACTACTACCTGGACG TCTGGGGCAAAGGGACCACGGTCACCGTGTCCTCA (SEQ ID NO: 146) |
| 4 | EVQLVESGGGLVQPGGSLRLSCA ASGFTFS<u>SYWMH</u>WVRQAPGKGLV WVS<u>RINSDGSSTSYADSVKG</u>RFT ISRDNAKNTLYLQMNSLRAEDTA VYYCCL<u>GVLLYNWFDPW</u>GQGTLV TVSS (SEQ ID NO: 137) | GAAGTGCAGCTGGTGGAAAGCGGCGGAGGCCTGGTGCAGCCTGGCG GCAGCCTGAGACTGTCTTGCGCCGCCAGCGGCTTCACCTTCAGCAG CTACTGGATGCACTGGGTCCGCCAGGCCCCTGGCAAGGGACTGGTC TGGGTGTCTCGAATCAACAGCGACGGCAGCAGCACCAGCTACGCCG ACAGCGTGAAGGGCCGGTTCACCATCAGCCGGGACAACGCCAAGAA CACCCTGTACCTGCAGATGAACAGCCTGCGGGCCGAGGACACCGCC GTGTATTACTGTTGTTTGGGTGTTTTATTATACAACTGGTTCGACC CCTGGGGCCAGGGAACCCTGGTCACCGTGTCCTCA (SEQ ID NO: 147) |

TABLE 8-continued

Exemplary anti-HLA-A*11 heavy and light chain sequences

| scFv | Protein Sequence | DNA Sequence |
|---|---|---|
| 3 | QVQLQESGPGLVKPSQTLSLTCT VSGGSIS<u>SGGYYW</u>SWIRQPPGKG LEWIG<u>YIYYSGSTYYNPSLKSRV</u> TISVDTSKNQFSLKLSSVTAADT AVYYCAR<u>HYYYYMDV</u>WGKGTTVT VSS (SEQ ID NO: 138) | CAGGTGCAGCTGCAGGAAAGCGGCCCTGGCCTGGTGAAACCCAGCC AGACCCTGAGCCTGACCTGCACAGTGTCCGGCGGCTCGATCAGCAG CGGCGGCTACTACTGGTCCTGGATCAGACAGCCCCCTGGCAAGGGC CTGGAATGGATCGGCTACATCTACTACAGCGGCAGCACCTACTACA ACCCCAGCCTGAAGTCCAGAGTGACCATCAGCGTGGACACCAGCAA GAACCAGTTCAGCCTGAAGCTGAGCAGCGTGACAGCCGCCGACACC GCTGTGTATTACTGTGCGAGACACTACTACTACTACATGGACGTCT GGGGCAAAGGGACCACGGTCACCGTGTCCTCA (SEQ ID NO: 148) |
| 2 | QITLKESGPTLVKPTQTLTLTCT FSGFSLS<u>TSGVGVG</u>WIRQPPGKA LEWLA<u>LIYWNDDKRYSPSLKSRL</u> TITKDTSKNQVVLTMTNMDPVDT ATYYCAH<u>KTTSFYFDY</u>WGQGTLV TVSS (SEQ ID NO: 139) | CAGATCACCCTGAAAGAGTCCGGCCCCACCCTGGTGAAACCCACCC AGACCCTGACCCTGACATGCACCTTCAGCGGCTTCAGCCTGAGCAC CTCTGGCGTGGGCGTGGGCTGGATCAGACAGCCTCCCGGCAAGGCC CTGGAATGGCTGGCCCTGATCTACTGGAACGACGACAAGCGGTACA GCCCCAGCCTGAAGTCCCGGCTGACCATCACCAAGGACACCTCGAA GAACCAGGTGGTGCTGACCATGACAAACATGGACCCCGTGGACACC GCCACATATTACTGTGCACACAAAACGACGTCGTTTTACTTTGACT ACTGGGGCCAGGGAACCCTGGTCACCGTGTCCTCA (SEQ ID NO: 149) |
| 1 | QVQLQESGPGLVKPSQTLSLTCT VSGGSIS<u>SGGYYW</u>SWIRQPPGKG LEWIG<u>YIYYSGSTYYNPSLKSRV</u> TISVDTSKNQFSLKLSSVTAADT AVYYCAR<u>HYYYYMDV</u>WGKGTTV TVSS (SEQ ID NO: 140) | CAGGTGCAGCTGCAGGAAAGCGGCCCTGGCCTGGTGAAACCCAGCC AGACCCTGAGCCTGACCTGCACAGTGTCCGGCGGCTCGATCAGCAG CGGCGGCTACTACTGGTCCTGGATCAGACAGCCCCCTGGCAAGGGC CTGGAATGGATCGGCTACATCTACTACAGCGGCAGCACCTACTACA ACCCCAGCCTGAAGTCCAGAGTGACCATCAGCGTGGACACCAGCAA GAACCAGTTCAGCCTGAAGCTGAGCAGCGTGACAGCCGCCGACACC GCTGTGTATTACTGTGCGAGACACTACTACTACTACATGGACG TCTGGGGCAAAGGGACCACGGTCACCGTGTCCTCA (SEQ ID NO: 150) |

Light Chain Sequence

| 1-9 | DIQMTQSPSSLSASVGDRVTITC <u>RASQSISSYLN</u>WYQQKPGKAPKL LIY<u>AASSLQS</u>GVPSRFSGSGSGT DFTLTISSLQPEDFATYYC<u>QQSY STPLT</u>FGGGTKVEIK (SEQ ID NO: 141) | GACATCCAGATGACCCAGTCTCCATCCTCCCTGTCTGCATCTGTAG GAGACAGAGTCACCATCACTTGCCGGGCAAGTCAGAGCATTAGCAG CTATTTAAATTGGTATCAGCAGAAACCAGGGAAAGCCCCTAAGCTC CTGATCTATGCTGCATCCAGTTTGCAAAGTGGGGTCCCATCAAGGT TCAGTGGCAGTGGATCTGGGACAGATTTCACTCTCACCATCAGCAG TCTGCAACCTGAAGATTTTGCAACTTACTACTGTCAACAGAGTTAC AGTACCCCTCTCACTTTCGGCGGCGGAACAAAGGTGGAGATCAAG (SEQ ID NO: 151) |

Differentially Expressed Inhibitor Ligands

The disclosure provides inhibitor ligands (non-target antigens) that are differentially expressed between cancer cells and normal cells.

Activation of the inhibitory receptor is mediated by the presence of the non-target antigen on the surface of a cell. A cell that expresses the non-target antigen will activate the inhibitory receptor based on the level of expression of the non-target antigen. In some embodiments, the non-target antigen is expressed by both target and non-target cells. However, in these embodiments, the non-target antigen is expressed by non-target cells at a higher level than the target cells. The higher levels of non-target antigen expressed by the non-target cells activate the inhibitory receptor, thereby preventing activation of the immune cell. In contrast, the lower levels of non-target antigen expressed by the target are not sufficient to activate the inhibitory receptor, leading to activation of the immune cell.

In alternative embodiments, the non-target antigen is expressed by non-target cells but not by target cells. In the absence of expression of the non-target antigen, the target cells activate the target receptor, thereby activating the immune cells.

Differential expression can be determined by any techniques known in the art used to measure expression. These include, inter alia, techniques for measuring mRNA and/or protein levels of a target gene in a cell. Methods of measuring protein levels in samples include immunohistochemistry, enzyme-linked immunosorbent assays (ELISA), and analytical methods such as liquid chromatography-mass spectrometry (LC-MS). Methods of measuring mRNA levels include real time quantitative reverse transcription PCR (qRT-PCR), as well as high throughput sequencing. Expression differences can be observed between, for example, a normal cell and a diseased cell, for example a cancer cell.

Activation of the inhibitory receptor by a non-target antigen can occur according to various modalities known in the art. Activation of the inhibitory receptor by a non-target antigen can be determined by methods known in the art. For example, the level of downstream intracellular signaling in a cell expressing the inhibitory receptor can be measured through the use of a reporter gene.

Without wishing to be bound by theory, whether or not expression of a non-target antigen inhibits activation of an immune cell via activation of the inhibitory receptor can occur according to the ratio of the non-target antigen to the inhibitor receptor. The expression levels of the non-target antigen and the inhibitory receptor, and the ratio thereof, can be determined by methods known in the art, including, inter alia, immunohistochemistry and fluorescence activated cell sorting (FACS). Analysis of the expression levels of the non-target antigen on target and non-target cells can be used to predict selective targeting of the immune cells expressing the inhibitory receptor. Low or no expression of the non-target antigen on a target or non-target cell can indicate, for example, that the inhibitory receptor will not be activated in an immune cell of the disclosure.

Alternatively, or in addition, and without wishing to be bound by theory, inhibition of immune cell activation by a non-target antigen via activation of the inhibitory receptor can depend on the affinity of the non-target antigen for the inhibitory receptor. Methods of measuring affinity are known in the art, and include, inter alia, enzyme-linked immunosorbent assay or radioimmunoassay methods.

Alternatively, or in addition, and without wishing to be bound by theory, inhibition of immune cell activation by a non-target antigen via activation of the inhibitory receptor can occur according to cross talk between the inhibitory receptor and the activator receptor, leading to down-regulation of the activity of the activator receptor. For example, activation of the inhibitory receptor by the non-target antigen can lead to reduced expression of the activator receptor on the surface of the immune cell.

In some embodiments, the non-target antigen is expressed at a lower level in a target cell than a normal cell. In some embodiments, the non-target antigen is expressed by healthy cells, i.e. cells that are not cancer cells. In some embodiments, the non-target antigen expression level is at least about 10 times less, at least about 30 times less, at least about 50 times less, at least about 70 times less, at least about 90 times less, at least about 100 times less, at least about 110 times less, at least about 150 times less, at least about 200 times less, at least about 250 times less, at least about 300 times less, at least about 350 times less, at least about 400 times less, at least about 450 times less, at least about 500 times less, at least about 600 times less, at least about 700 times less, at least about 800 times less, at least about 900 times less or at least about 1000 times less in the target cell than in the non-target cell. In some embodiments, the non-target antigen expression level is about 10 times less, about 30 times less, about 50 times less, about 70 times less, about 90 times less, about 100 times less, or about 110 times less than the plurality of healthy cells. In some embodiments, the non-target antigen expression level is at least about 5 times less in the plurality of cancer cells than in the plurality of healthy cells. In some embodiments, the non-target antigen expression level is at least about 5 times less in a target cell than a non-target cell. In some embodiments, the target cells are a plurality of cancer cells that have low or no expression of the non-target antigen.

Any cell surface molecule expressed by the non-target cells that is not expressed by target cells (or expressed at a low level) may be a suitable non-target antigen for the second receptor extracellular ligand binding domain. For example, a cell adhesion molecule, a cell-cell signaling molecule, an extracellular domain, a molecule involved in chemotaxis, a glycoprotein, a G protein-coupled receptor, a transmembrane protein, a receptor for a neurotransmitter or a voltage gated ion channel can be used as a non-target antigen.

In some embodiments, the non-target antigen is selected from the group consisting of leucine rich repeat neuronal 4 (LRRN4) and uroplakin B3 (UPKB3), or a peptide antigen of any of these in a complex with a major histocompatibility complex class I (MHC-I). In some embodiments, the non-target antigen is LRRN4 or a peptide antigen thereof in a complex with MHC-I. In some embodiments, the non-target antigen is UPKB3 or a peptide antigen thereof in a complex with MHC-I.

In some embodiments, the target antigen is a peptide antigen of a cancer cell-specific antigen in a complex with a major histocompatibility complex class I (MHC-I).

Non-target MHC-I (pMHC) antigens comprising any of HLA-A, HLA-B or HLA-C are envisaged as within the scope of the disclosure. In some embodiments, the non-target antigen comprises HLA-A. In some embodiments, the non-target antigen comprises HLA-B. In some embodiments, the non-target antigen comprises HLA-C.

Non-target antigens comprise proteins that have low or no expression in cancer cells, for example lung cancer cells, but are expressed in normal tissues, such as normal lung tissue.

In some embodiments, the non-target antigen comprises LRRN4 or an antigen peptide thereof in a complex with MHC-I. A human LRRN4 is described in NCBI record number NP_689824.2, the contents of which are incorporated by reference herein in their entirety. In some embodiments, LRRN4 comprises an amino acid sequence of:

```
                                                    (SEQ ID NO: 75)
  1 MRQTLPLLLL TVLRPSWADP PQEKVPLFRV

TQQGPWGSSG SNATDSPCEG LPAADATALT

61 LANRNLERLP GCLPRTLRSL DASHNLLRAL

STSELGHLEQ LQVLTLRHNR IAALRWGPGG

121 PAGLHTLDLS YNQLAALPPC TGPALSSLRA

LALAGNPLRA LQPRAFACFP ALQLLNLSCT

181 ALGRGAQGGI AEAAFAGEDG APLVTLEVLD

LSGTFLERVE SGWIRDLPKL TSLYLRKMPR

241 LTTLEGDIFK MTPNLQQLDC QDSPALASVA

THIFQDTPHL QVLLFQNCNL SSFPPWTLDS

301 SQVLSINLFG NPLTCSCDLS WLLTDAKRTV

LSRAADTMCA PAAGSSGPFS ASLSLSQLPG

361 VCQSDQSTTL GASHPPCFNR STYAQGTTVA

PSAAPATRPA GDQQSVSKAP NVGSRTIAAW

421 PHSDAREGTA PSTTNSVAGH SNSSVFPRAA

STTRTQHRGE HAPELVLEPD ISAASTPLAS

481 KLLGPFPTSW DRSISSPQPG QRTHATPQAP

NPSLSEGEIP VLLLDDYSEE EEGRKEEVGT

541 PHQDVPCDYH PCKHLQTPCA ELQRRWRCRC

PGLSGEDTIP DPPRLQGVTE TTDTSALVHW

601 CAPNSWHGY QIRYSAEGVVA GNQSVVGVIY

ATARQHPLYG LSPGTTYRVC VLAANRAGLS

661 QPRSSGWRSP CAAFTTKPSF ALLLSGLCAA

SGLLLASTVV LSACLCRRGQ TLGLQRCDTH

721 LVAYKNPAFD DYPLGLQTVS.
```

In some embodiments, LRRN4 comprises a sequence that shares at least 80%, at least 85%, at least 90%, at least 95%, at least 96%, at least 97%, at least 98%, or at least 99% identity to SEQ ID NO: 75. In some embodiments, LRRN4 comprises a sequence identical to SEQ ID NO: 75.

In some embodiments, the non-target antigen comprises UPK3B or an antigen peptide thereof in a complex with MHC-I. All isoforms of UPK3B are envisaged as within the scope of the instant disclosure. A human UPK3B isoform a precursor is described in NCBI record number NP_085047.1, the contents of which are incorporated by reference herein in their entirety. In some embodiments, UPK3B isoform a precursor comprises an amino acid sequence of:

(SEQ ID NO: 76)
```
  1 MGLPWGQPHL GLQMLLLALN CLRPSLSLGE

WGSWMDASSQ TQGAGGPAGV IGPWAPAPLR

61 LGEAAPGTPT PVSVAHLLSP VATELVPYTP

QITAWDLEGK VTATTFSLEQ PRCVEDGLAS

121 ASDTVWLVVA FSNASRGFQN PETLADIPAS

PQLLTDGHYM TLPLSPDQLP CGDPMAGSGG

181 APVLRVGHDH GCHQQPFCNA PLPGPGPYRE

DPRIHRHLAR AAKWQHDRHY LHPLFSGRPP

241 TLGLLGSLYH ALLQPVVAGG GPGAAADRLL

HGQALHDPPH PTQRGRHTAG GLQAWPGPPP

301 QPQPLAWPLC MGLGEMGRRE.
```

A human UPK3B isoform b precursor is described in NCBI record number NP_872625.1, the contents of which are incorporated by reference herein in their entirety. In some embodiments, UPK3B isoform b precursor comprises an amino acid sequence of:

(SEQ ID NO: 77)
```
  1 MGLPWGQPHL GLQMLLLALN CLRPSLSLEL

VPYTPQITAW DLEGKVTATT FSLEQPRCVF

61 DGLASASDTV WLWAFSNAS RGFQNPETLA

DIPASPQLLT DGHYMTLPLS PDQLPCGDPM

121 AGSGGAPVLR VGHDHGCHQQ PFCNAPLPGP

GPYRVKFLLM DTRGSPRAET KWSDPITLHQ

181 GKTPGSIDTW PGRRSGSMIV ITSILSSLAG

LLLLAFLAAS TMRFSSLWWP EEAPEQLRIG

241 SEMGKRYMTH HIPPSEAATL PVGCKPGLDP.

LPSLSP
```

A human UPK3B isoform c precursor is described in NCBI record number NP_872624.1, the contents of which are incorporated by reference herein in their entirety. In some embodiments, UPK3B isoform c precursor comprises an amino acid sequence of:

(SEQ ID NO: 78)
```
  1 MGLPWGQPHL GLQMLLLALN CLRPSLSLEL

VPYTPQITAW DLEGKVTATT FSLEQPRCVF

61 DGLASASDTV WLWAFSNAS RGFQNPETLA

DIPASPQLLT DGHYMTLPLS PDQLPCGDPM

121 AGSGGAPVLR VGHDHGCHQQ PFCNAPLPGP

GPYREDPRIH RHLARAAKWQ HDRHYLHPLF
```

```
181 SGRPPTLGLL GSLYHALLQP VVAGGGPGAA

ADRLLHGQAL HDPPHPTQRG RHTAGGLQAW

241 PGPPPQPQPL AWPLCMGLGE MGRRE.
```

A human UPK3B isoform d precursor is described in NCBI record number NP_001334613.1, the contents of which are incorporated by reference herein in their entirety. In some embodiments, UPK3B isoform c precursor comprises an amino acid sequence of:

(SEQ ID NO: 79)
```
  1 MGLPWGQPHL GLQMLLLALN CLRPSLSLEL

VPYTPQITAW DLEGKVTATT FSLEQPRCVF

61 DGLASASDTV WLVVAFSNAS RGFQNPETLA

DIPASPQLLT DGHYMTLPLS PDQLPCGDPM

121 AGSGGAPVLR VGHDHGCHQQ PFCNAPLPGP

GPYRVKFLLM DTRGSPRAET KWSDPITLHQ

181 GKTPGSIDTW PGRRSGSMIV ITSILSSLAG

LLLLAFLAAS TMRFSSLWWP EEAPEQLRIG

241 SFMGKRYMTH HIPPREAATL PVGCKPGLDP

LPSLSP.
```

In some embodiments, UPKB3 comprises a sequence or subsequence that shares at least 80%, at least 85%, at least 90%, at least 95%, at least 96%, at least 97%, at least 98%, or at least 99% identity to any one of SEQ ID NOs: 76-79. In some embodiments, UPKB3 comprises a sequence or subsequence identical to SEQ ID NOs: 76-79.

Inhibitory Chimeric Antigen Receptors

The disclosure provides a second receptor that is an inhibitory chimeric antigen receptor. The inhibitory receptor may comprise an extracellular ligand binding domain that binds to and recognizes the non-target antigen or a peptide derivative thereof in a MHC-I complex.

The term "inhibitory receptor" as used herein refers to a ligand-binding domain that is fused to an intracellular signaling domain capable of transducing an inhibitory signal that inhibits or suppresses the immune activity of an immune cell. Inhibitory receptors have immune cell inhibitory potential, and are distinct and distinguishable from CARs, which are receptors with immune cell activating potential. For example, CARs are activating receptors as they include intracellular stimulatory and/or co-stimulatory domains. Inhibitory receptors are inhibiting receptors that contain intracellular inhibitory domains.

As used herein "inhibitory signal" refers to signal transduction or changes in protein expression in an immune cell resulting in suppression of an immune response (e.g., decrease in cytokine production or reduction of immune cell activation). Inhibition or suppression of an immune cell can selective and/or reversible, or not selective and/or reversible.

Inhibitory receptors of the disclosure may comprise an extracellular ligand binding domain. Any type of ligand binding domain that can regulate the activity of a receptor in a ligand dependent manner is envisaged as within the scope of the instant disclosure. Inhibitory receptors are responsive to non-target antigens (e.g. HLA-A*02). For example, when a non-target antigen (e.g. HLA-A*02) binds to or contacts the inhibitory receptor, the inhibitory receptor is responsive and activates an inhibitory signal in the immune cell expressing the inhibitory receptor upon binding of the non-target antigen by the extracellular ligand binding domain of the inhibitory receptor.

Inhibitory receptors of the disclosure may comprise an extracellular ligand binding domain. Any type of ligand binding domain that can regulate the activity of a receptor in a ligand dependent manner is envisaged as within the scope of the instant disclosure.

In some embodiments, the ligand binding domain is an antigen binding domain. Exemplary antigen binding domains include, inter alia, scFv, SdAb, Vβ-only domains, and TCR antigen binding domains derived from the TCR α and β chain variable domains.

Any type of antigen binding domain is envisaged as within the scope of the instant disclosure.

In some embodiments, the extracellular ligand binding domain of the second receptor is an scFv.

In some embodiments, the extracellular ligand binding domain of the second receptor binds to and recognizes a polymorphic variant of intercellular adhesion molecule 1 (ICAM1), catechol-O-methyltransferase (COMT), C—X—C motif chemokine ligand 16 (CXCL16), leucine rich repeat neuronal 4 (LRRN4) and uroplakin 3B UPK3B, or an antigen peptide thereof in a complex with a major histocompatibility complex class I (MHC-I), or HLA-A*02. In some embodiments, the extracellular ligand binding domain of the second receptor is an scFv.

In some embodiments, the extracellular ligand binding domain of the second receptor is fused to the extracellular domain of an inhibitory receptor.

In some embodiments, the inhibitory receptors of the present disclosure comprise an extracellular hinge region. Exemplary hinges can be isolated or derived from IgD and CD8 domains, for example IgG1. In some embodiments, the hinge is isolated or derived from CD8α or CD28.

The inhibitory receptors of the present disclosure can be designed to comprise a transmembrane domain that is fused to the extracellular domain of the inhibitory receptor. In some instances, the transmembrane domain can be selected or modified by amino acid substitution to avoid binding of such domains to the transmembrane domains of the same or different surface membrane proteins to minimize interactions with other members of the receptor complex.

The transmembrane domain may be derived either from a natural or from a synthetic source. Where the source is natural, the domain may be derived from any membrane-bound or transmembrane protein. Transmembrane regions may be isolated or derived from (i.e. comprise at least the transmembrane region(s) of) the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137, CD154, or from an immunoglobulin such as IgG4. Alternatively the transmembrane domain may be synthetic, in which case it will comprise predominantly hydrophobic residues such as leucine and valine. In some embodiments, a triplet of phenylalanine, tryptophan and valine will be found at each end of a synthetic transmembrane domain. Optionally, a short oligo- or polypeptide linker, preferably between 2 and 10 amino acids in length may form the linkage between the transmembrane domain and the intracellular domain of the inhibitory receptor. A glycine-serine doublet provides a particularly suitable linker.

The disclosure provides an inhibitory receptor comprising an intracellular domain. The intracellular domain of the inhibitory receptors of the instant disclosure is responsible for inhibiting activation of the immune cells comprising the inhibitory receptor, which would otherwise be activated in response to activation signals by the first receptor. In some embodiments, the inhibitory intracellular domain comprises an immunoreceptor tyrosine-based inhibitory motif (ITIM). In some embodiments, the inhibitory intracellular domain comprising an ITIM can be isolated or derived from an immune checkpoint inhibitor such as CTLA-4 and PD-1. CTLA-4 and PD-1 are immune inhibitory receptors expressed on the surface of T cells, and play a pivotal role in attenuating or terminating T cell responses.

In some embodiments, an inhibitory intracellular domain is isolated from human tumor necrosis factor related apoptosis inducing ligand (TRAIL) receptor and CD200 receptor 1. In some embodiments, the TRAIL receptor comprises TR10A, TR10B or TR10D.

In some embodiments, an inhibitory intracellular domain is isolated from phosphoprotein membrane anchor with glycosphingolipid microdomains 1 (PAG1). In some embodiments, an inhibitory intracellular domain is isolated from leukocyte immunoglobulin like receptor B1 (LILRB1).

In some embodiments, the inhibitory domain is isolated or derived from a human protein, for example a human TRAIL receptor, CTLA-4, PD-1, PAG1 or LILRB1 protein.

In some embodiments, the inhibitory domain comprises an intracellular domain, a transmembrane or a combination thereof. In some embodiments, the inhibitory domain comprises an intracellular domain, a transmembrane domain, a hinge region or a combination thereof.

In some embodiments, the inhibitory domain is isolated or derived from killer cell immunoglobulin like receptor, three Ig domains and long cytoplasmic tail 2 (KIR3DL2), killer cell immunoglobulin like receptor, three Ig domains and long cytoplasmic tail 3 (KIR3DL3), leukocyte immunoglobulin like receptor B1 (LIR1, also called LIR-1 and LILRB1), programmed cell death 1 (PD-1), Fc gamma receptor IIB (FcgRIIB), killer cell lectin like receptor K1 (NKG2D), CTLA-4, a domain containing a synthetic consensus ITIM, a ZAP70 SH2 domain (e.g., one or both of the N and C terminal SH2 domains), or ZAP70 KI_K369A (kinase inactive ZAP70).

In some embodiments, the inhibitory domain is isolated or derived from a human protein.

In some embodiments, the second, inhibitory receptor comprises an inhibitory domain. In some embodiments, the second, inhibitory receptor comprises an inhibitory intracellular domain and/or an inhibitory transmembrane domain. In some embodiments, the inhibitory intracellular domain is fused to an intracellular domain of an inhibitory receptor. In some embodiments, the inhibitory intracellular domain is fused to the transmembrane domain of an inhibitory receptor.

In some embodiments, the second, inhibitory receptor comprises a cytoplasmic domain, a transmembrane domain, and an extracellular domain or a portion thereof isolated or derived isolated or derived from the same protein, for example an ITIM containing protein. In some embodiments, the second, inhibitory receptor comprises a hinge region isolated or derived from isolated or derived from the same protein as the intracellular domain and/or transmembrane domain, for example an ITIM containing protein.

In some embodiments, the second receptor is a TCR comprising an inhibitory domain (an inhibitory TCR). In some embodiments, the inhibitory TCR comprises an inhibitory intracellular domain and/or an inhibitory transmembrane domain. In some embodiments, the inhibitory intracellular domain is fused to the intracellular domain of TCR alpha, TCR beta, CD3 delta, CD3 gamma or CD3 epsilon or a portion thereof a TCR. In some embodiments, the inhibitory intracellular domain is fused to the transmembrane domain of TCR alpha, TCR beta, CD3 delta, CD3 gamma or CD3 epsilon.

In some embodiments, the second receptor is a TCR comprising an inhibitory domain (an inhibitory TCR). In some embodiments, the inhibitory domain is isolated or derived from LILRB1.

LILRB1 Inhibitory Receptors

The disclosure provides a second, inhibitory receptor comprising a LILRB1 inhibitory domain, and optionally, a LILRB1 transmembrane and/or hinge domain, or functional variants thereof. The inclusion of the LILRB1 transmembrane domain and/or the LILRB1 hinge domain in the inhibitory receptor may increase the inhibitory signal generated by the inhibitory receptor compared to a reference inhibitory receptor having another transmembrane domain or another hinge domains. The second, inhibitory receptor comprising the LILRB1 inhibitory domain may be a CAR or TCR, as described herein. Any suitable ligand binding domain, as described herein, may be fused to the LILRB1-based second, inhibitory receptors.

Leukocyte immunoglobulin-like receptor subfamily B member 1 (LILRB1), also known as Leukocyte immunoglobulin-like receptor B1, as well as ILT2, LIR1, MIR7, PIRB, CD85J, ILT-2 LIR-1, MIR-7 and PIR-B, is a member of the leukocyte immunoglobulin-like receptor (LIR) family. The LILRB1 protein belongs to the subfamily B class of LIR receptors. These receptors contain two to four extracellular immunoglobulin domains, a transmembrane domain, and two to four cytoplasmic immunoreceptor tyrosine-based inhibitory motifs (ITIMs). The LILRB1 receptor is expressed on immune cells, where it binds to MHC class I molecules on antigen-presenting cells and transduces a negative signal that inhibits stimulation of an immune response. LILRB1 is thought to regulate inflammatory responses, as well as cytotoxicity, and to play a role in limiting auto-reactivity. Multiple transcript variants encoding different isoforms of LILRB1 exist, all of which are contemplated as within the scope of the instant disclosure.

In some embodiments of the inhibitory receptors described herein, the inhibitory receptor comprises one or more domains isolated or derived from LILRB1. In some embodiments of the receptors having one or more domains isolated or derived from LILRB1, the one or more domains of LILRB1 comprise an amino acid sequence that is at least 80%, at least 90%, at least 95%, at least 96%, at least 97%, at least 98%, at least 99% or is identical to a sequence or subsequence of SEQ ID NO: 54. In some embodiments, the one or more domains of LILRB1 comprise an amino acid sequence that is identical to a sequence or subsequence of SEQ ID NO: 54. In some embodiments, the one or more domains of LILRB1 consist of an amino acid sequence that is at least 80%, at least 90%, at least 95%, at least 96%, at least 97%, at least 98%, at least 99% or is identical to a sequence or subsequence of SEQ ID NO: 54. In some embodiments, the one or more domains of LILRB1 consist of an amino acid sequence that is identical to a sequence or subsequence of SEQ ID NO: 54.

In some embodiments of the receptors having one or more domains isolated or derived from LILRB1, the one or more domains of LILRB1 are encoded by a polynucleotide sequence that is at least 80%, at least 90%, at least 95%, at least 96%, at least 97%, at least 98%, at least 99% or is identical to a sequence or subsequence of SEQ ID NO: 55.

In some embodiments of the receptors having one or more domains of LILRB1, the one or more domains of LILRB1 are encoded by a polynucleotide sequence that is identical to a sequence or subsequence of SEQ ID NO: 55.

In various embodiments, an inhibitory receptor is provided, comprising a polypeptide, wherein the polypeptide comprises one or more of: an LILRB1 hinge domain or functional variant thereof; an LILRB1 transmembrane domain or a functional variant thereof; and an LILRB1 intracellular domain or an intracellular domain comprising at least one, or at least two immunoreceptor tyrosine-based inhibitory motifs (ITIMs), wherein each ITIM is independently selected from NLYAAV (SEQ ID NO: 56), VTYAEV (SEQ ID NO: 57), VTYAQL (SEQ ID NO: 58), and SIYATL (SEQ ID NO: 59).

As used herein an "immunoreceptor tyrosine-based inhibitory motif" or "ITIM" refers to a conserved sequence of amino acids with a consensus sequence of S/I/V/LxYxxI/V/L (SEQ ID NO: 547), or the like, that is found in the cytoplasmic tails of many inhibitory receptors of the immune system. After ITIM-possessing inhibitory receptors interact with their ligand, the ITIM motif is phosphorylated, allowing the inhibitory receptor to recruit other enzymes, such as the phosphotyrosine phosphatases SHP-1 and SHP-2, or the inositol-phosphatase called SHIP.

In some embodiments, the polypeptide comprises an intracellular domain comprising at least one immunoreceptor tyrosine-based inhibitory motif (ITIM), at least two ITIMs, at least 3 ITIMs, at least 4 ITIMs, at least 5 ITIMs or at least 6 ITIMs. In some embodiments, the intracellular domain has 1, 2, 3, 4, 5, or 6 ITIMs.

In some embodiments, the polypeptide comprises an intracellular domain comprising at least one ITIM selected from the group of ITIMs consisting of NLYAAV (SEQ ID NO: 56), VTYAEV (SEQ ID NO: 57), VTYAQL (SEQ ID NO: 58), and SIYATL (SEQ ID NO: 59).

In further particular embodiments, the polypeptide comprises an intracellular domain comprising at least two immunoreceptor tyrosine-based inhibitory motifs (ITIMs), wherein each ITIM is independently selected from NLYAAV (SEQ ID NO: 56), VTYAEV (SEQ ID NO: 57), VTYAQL (SEQ ID NO: 58), and SIYATL (SEQ ID NO: 59).

In some embodiments, the intracellular domain comprises both ITIMs NLYAAV (SEQ ID NO: 56) and VTYAEV (SEQ ID NO: 57). In some embodiments, the intracellular domain comprises a sequence at least 95% identical to SEQ ID NO: 60. In some embodiments, the intracellular domain comprises or consists essentially of a sequence identical to SEQ ID NO: 60.

In some embodiments, the intracellular domain comprises both ITIMs VTYAEV (SEQ ID NO: 57) and VTYAQL (SEQ ID NO: 58). In some embodiments, the intracellular domain comprises a sequence at least 95% identical to SEQ ID NO: 61. In some embodiments, the intracellular domain comprises or consists essentially of a sequence identical to SEQ ID NO: 61.

In some embodiments, the intracellular domain comprises both ITIMs VTYAQL (SEQ ID NO: 58) and SIYATL (SEQ ID NO: 59). In some embodiments, the intracellular domain comprises a sequence at least 95% identical to SEQ ID NO: 62. In some embodiments, the intracellular domain comprises or consists essentially of a sequence identical to SEQ ID NO: 62.

In some embodiments, the intracellular domain comprises the ITIMs NLYAAV (SEQ ID NO: 56), VTYAEV (SEQ ID NO: 57), and VTYAQL (SEQ ID NO: 58). In some embodiments, the intracellular domain comprises a sequence at least 95% identical to SEQ ID NO: 63. In some embodiments, the intracellular domain comprises or consists essentially of a sequence identical to SEQ ID NO: 63.

In some embodiments, the intracellular domain comprises the ITIMs VTYAEV (SEQ ID NO: 57), VTYAQL (SEQ ID NO: 58), and SIYATL (SEQ ID NO: 59). In some embodiments, the intracellular domain comprises a sequence at least 95% identical to SEQ ID NO: 64. In some embodiments, the intracellular domain comprises or consists essentially of a sequence identical to SEQ ID NO: 64.

In some embodiments, the intracellular domain comprises the ITIMs NLYAAV (SEQ ID NO: 56), VTYAEV (SEQ ID NO: 57), VTYAQL (SEQ ID NO: 58), and SIYATL (SEQ ID NO: 59). In some embodiments, the intracellular domain comprises a sequence at least 95% identical to SEQ ID NO: 65. In some embodiments, the intracellular domain comprises or consists essentially of a sequence identical to SEQ ID NO: 65.

In some embodiments, the intracellular domain comprises a sequence at least 95% identical to the LILRB1 intracellular domain (SEQ ID NO: 70). In some embodiments, the intracellular domain comprises or consists essentially of a sequence identical to the LILRB1 intracellular domain (SEQ ID NO: 70).

LILRB1 intracellular domains or functional variants thereof of the disclosure can have at least 1, at least 2, at least 4, at least 4, at least 5, at least 6, at least 7, or at least 8 ITIMs. In some embodiments, the LILRB1 intracellular domain or functional variant thereof has 2, 3, 4, 5, or 6 ITIMs.

In particular embodiments, the intracellular domain comprises two, three, four, five, or six immunoreceptor tyrosine-based inhibitory motifs (ITIMs), wherein each ITIM is independently selected from NLYAAV (SEQ ID NO: 56), VTYAEV (SEQ ID NO: 57), VTYAQL (SEQ ID NO: 58), and SIYATL (SEQ ID NO: 59).

In particular embodiments, the intracellular domain comprises at least three immunoreceptor tyrosine-based inhibitory motifs (ITIMs), wherein each ITIM is independently selected from NLYAAV (SEQ ID NO: 56), VTYAEV (SEQ ID NO: 57), VTYAQL (SEQ ID NO: 58), and SIYATL (SEQ ID NO: 59).

In particular embodiments, the intracellular domain comprises three immunoreceptor tyrosine-based inhibitory motifs (ITIMs), wherein each ITIM is independently selected from NLYAAV (SEQ ID NO: 56), VTYAEV (SEQ ID NO: 57), VTYAQL (SEQ ID NO: 58), and SIYATL (SEQ ID NO: 59).

In particular embodiments, the intracellular domain comprises four immunoreceptor tyrosine-based inhibitory motifs (ITIMs), wherein each ITIM is independently selected from NLYAAV (SEQ ID NO: 56), VTYAEV (SEQ ID NO: 57), VTYAQL (SEQ ID NO: 58), and SIYATL (SEQ ID NO: 59).

In particular embodiments, the intracellular domain comprises five immunoreceptor tyrosine-based inhibitory motifs (ITIMs), wherein each ITIM is independently selected from NLYAAV (SEQ ID NO: 56), VTYAEV (SEQ ID NO: 57), VTYAQL (SEQ ID NO: 58), and SIYATL (SEQ ID NO: 59).

In particular embodiments, the intracellular domain comprises six immunoreceptor tyrosine-based inhibitory motifs (ITIMs), wherein each ITIM is independently selected from NLYAAV (SEQ ID NO: 56), VTYAEV (SEQ ID NO: 57), VTYAQL (SEQ ID NO: 58), and SIYATL (SEQ ID NO: 59).

In particular embodiments, the intracellular domain comprises at least seven immunoreceptor tyrosine-based inhibitory motifs (ITIMs), wherein each ITIM is independently selected from NLYAAV (SEQ ID NO: 56), VTYAEV (SEQ ID NO: 57), VTYAQL (SEQ ID NO: 58), and SIYATL (SEQ ID NO: 59).

The LILRB1 protein has four immunoglobulin (Ig) like domains termed D1, D2, D3 and D4. In some embodiments, the LILRB1 hinge domain comprises an LILRB1 D3D4 domain or a functional variant thereof. In some embodiments, the LILRB1 D3D4 domain comprises a sequence at least 95%, at least 96%, at least 97%, at least 98%, at least 99% or identical to SEQ ID NO: 66. In some embodiments, the LILRB1 D3D4 domain comprises or consists essentially of SEQ ID NO: 66.

In some embodiments, the polypeptide comprises the LILRB1 hinge domain or functional variant thereof. In embodiments, the LILRB1 hinge domain or functional variant thereof comprises a sequence at least 95%, at least 96%, at least 97%, at least 98%, at least 99% identical or identical to SEQ ID NO: 73, SEQ ID NO: 66, or SEQ ID NO: 67. In embodiments, the LILRB1 hinge domain or functional variant thereof comprises a sequence at least 95% identical to SEQ ID NO: 73, SEQ ID NO: 66, or SEQ ID NO: 67.

In some embodiments, the LILRB1 hinge domain comprises a sequence identical to SEQ ID NO: 73, SEQ ID NO: 66, or SEQ ID NO: 67.

In some embodiments, the LILRB1 hinge domain consists essentially of a sequence identical to SEQ ID NO: 73, SEQ ID NO: 66, or SEQ ID NO: 67.

In some embodiments, the transmembrane domain is a LILRB1 transmembrane domain or a functional variant thereof. In some embodiments, the LILRB1 transmembrane domain or a functional variant thereof comprises a sequence at least 95% identical, at least 96% identical, at least 97% identical, at least 98% identical or at least 99% to SEQ ID NO: 74. In some embodiments, the LILRB1 transmembrane domain or a functional variant thereof comprises a sequence at least 95% identical to SEQ ID NO: 74. In some embodiments, the LILRB1 transmembrane domain comprises a sequence identical to SEQ ID NO: 74. In embodiments, the LILRB1 transmembrane domain consists essentially of a sequence identical to SEQ ID NO: 74.

In some embodiments, the transmembrane domain can be attached to the extracellular region of the second, inhibitory receptor, e.g., the antigen binding domain or ligand binding domain, via a hinge, e.g., a hinge from a human protein. For example, in some embodiments, the hinge can be a human immunoglobulin (Ig) hinge, e.g., an IgG4 hinge, a CD8α hinge or an LILRB1 hinge.

In some embodiments, the second, inhibitory receptor comprises an inhibitory domain. In some embodiments, the second, inhibitory receptor comprises an inhibitory intracellular domain and/or an inhibitory transmembrane domain. In some embodiments, the inhibitory domain is isolated or derived from LILR1B.

Inhibitory Receptors Comprising Combinations of LILRB1 Domains

In some embodiments, the LILRB1-based inhibitory receptors of the disclosure comprise more than one LILRB1 domain or functional equivalent thereof. For example, in some embodiments, the inhibitory receptor comprises an LILRB1 transmembrane domain and intracellular domain, or an LILRB1 hinge domain, transmembrane domain and intracellular domain.

In particular embodiments, the inhibitory receptor comprises an LILRB1 hinge domain or functional variant thereof, and the LILRB1 transmembrane domain or a functional variant thereof. In some embodiments, the polypeptide comprises a sequence at least 95% identical, at least 96% identical, at least 97% identical, at least 98% identical, at least 99% identical or identical to SEQ ID NO: 68. In some embodiments, the polypeptide comprises a sequence at least 95% identical to SEQ ID NO: 68. In some embodiments, the polypeptide comprises a sequence identical to SEQ ID NO: 68.

In further embodiments, the inhibitory receptor comprises: the LILRB1 transmembrane domain or a functional variant thereof, and an LILRB1 intracellular domain and/or an intracellular domain comprising at least one immunoreceptor tyrosine-based inhibitory motif (ITIM), wherein the ITIM is selected from NLYAAV (SEQ ID NO: 56), VTYAEV (SEQ ID NO: 57), VTYAQL (SEQ ID NO: 58), and SIYATL (SEQ ID NO: 59).

In some embodiments, the polypeptide comprises the LILRB1 transmembrane domain or a functional variant thereof, and an LILRB1 intracellular domain and/or an intracellular domain comprising at least two ITIM, wherein each ITIM is independently selected from NLYAAV (SEQ ID NO: 56), VTYAEV (SEQ ID NO: 57), VTYAQL (SEQ ID NO: 58), and SIYATL (SEQ ID NO: 59).

In some embodiments, the inhibitory receptor comprises a LILRB1 transmembrane domain and intracellular domain. In some embodiments, the polypeptide comprises a sequence at least 95% identical, at least 96% identical, at least 97% identical, at least 98% identical, at least 99% identical or identical to SEQ ID NO: 69. In some embodiments, the polypeptide comprises a sequence at least 95% identical to SEQ ID NO: 69. In some embodiments, the polypeptide comprises a sequence identical to SEQ ID NO: 69.

In preferred embodiments, the inhibitory receptor comprises: an LILRB1 hinge domain or functional variant thereof; an LILRB1 transmembrane domain or a functional variant thereof; and an LILRB1 intracellular domain and/or an intracellular domain comprising at least two immunoreceptor tyrosine-based inhibitory motifs (ITIMs), wherein each ITIM is independently selected from LYAAV (SEQ ID NO: 56), VTYAE (SEQ ID NO: 57), VTYAQL (SEQ ID NO: 58), and SIYATL (SEQ ID NO: 59).

In some embodiments, the inhibitory receptor comprises a sequence at least 95% identical to SEQ ID NO: 71 or SEQ ID NO: 72, or at least 99% identical to SEQ ID NO: 71 or SEQ ID NO: 72, or identical to SEQ ID NO: 71 or SEQ ID NO: 72.

In some embodiments, the polypeptide comprises a sequence at least 99% identical to SEQ ID NO: 68, or at least 99% identical to SEQ ID NO: 68, or identical to SEQ ID NO: 68.

In some embodiments, the polypeptide comprises a sequence at least 99% identical to SEQ ID NO: 69, or at least 99% identical to SEQ ID NO: 69, or identical to SEQ ID NO: 69.

TABLE 9

Polypeptide sequences for illustrative LILRB1-based inhibitory receptors

| Name | Sequence |
| --- | --- |
| LILRB1 | MTPILTVLICLGLSLGPRTHVQAGHLPKPTLWAEPGSVITQ GSPVTLRCQGGQETQEYRLYREKKTALWITRIPQELVKKG QFPIPSITWEHAGRYRCYYGSDTAGRSESSDPLELVVTGA YIKPTLSAQPSPVVNSGGNVILQCDSQVAFDGFSLCKEGED EHPQCLNSQPHARGSSRAIFSVGPVSPSRRWWYRCYAYDS NSPYEWSLPSDLLELLVLGVSKKPSLSVQPGPIVAPEETLT LQCGSDAGYNRFVLYKDGERDFLQLAGAQPQAGLSQANF TLGPVSRSYGGQYRCYGAHNLSSEWSAPSDPLDILIAGQF YDRVSLSVQPGPTVASGENVTLLCQSQGWMQTFLLTKEG AADDPWRLRSTYQSQKYQAEFPMGPVTSAHAGTYRCYGS QSSKPYLLTHPSDPLELVVSGPSGGPSSPTTGPTSTSGPE DQPLTPTGSDPQSGLGRHLGVVIGILVAVILLLLLLLLF LILRHRRQGKHWTSTQRKADFQHPAGAVGPEPTDRGLQWR SSPAADAQEENLYAAVKHTQPEDGVEMDTRSPHDEDPQA VTYAEVKHSRPRREMASPPSPLSGEFLDTKDRQAEEDRQ MDTEAAASEAPQDVTYAQLHSLTLRREATEPPPSQEGPS PAVPSIYATLAIHPSQEGPSPAVPSIYATLAIH SEQ ID NO: 54 |
| LILRB1 hinge-transmembrane-intracellular domain | YGSQSSKPYLLTHPSDPLELVVSGPSGGPSSPTTGPTSTSG PEDQPLTPTGSDPQSGLGRHLGVVIGILVAVILLLLLLLL FLILRHRRQGKHWTSTQRKADFQHPAGAVGPEPTDRGLQ WRSSPAADAQEENLYAAVKHTQPEDGVEMDTRSPHDEDP QAVTYAEVKHSRPRREMASPPSPLSGEFLDTKDRQAEEDR QMDTEAAASEAPQDVTYAQLHSLTLRREATEPPPSQEGPS PAVPSIYATLAIH SEQ ID NO: 71 |
| LILRB1 hinge-transmembrane-intracellular domain (w/o YGSQSSKPYL LTHPSDPLEL (SEQ ID NO: 66)) | VVSGPSGGPSSPTTGPTSTSGPEDQPLTPTGSDPQSGLGRH LGVVIGILVAVILLLLLLLLFLILRHRRQGKHWTSTQRK ADFQHPAGAVGPEPTDRGLQWRSSPAADAQEENLYAAV KHTQPEDGVEMDTRSPHDEDPQAVTYAEVKHSRPRREMA SPPSPLSGEFLDTKDRQAEEDRQMDTEAAASEAPQDVTYA QLHSLTLRREATEPPPSQEGPSPAVPSIYATLAIH SEQ ID NO: 72 |

TABLE 9-continued

Polypeptide sequences for illustrative LILRB1-based inhibitory receptors

| Name | Sequence |
|---|---|
| LILRB1 hinge domain | YGSQSSKPYLLTHPSDPLELVVSGPSGGPSSPTTGPTS TSGPEDQPLTPTGSDPQSGLGRHLG<br>SEQ ID NO: 73 |
| LILRB1 transmembrane domain | VVIGILVAVILLLLLLLLFLIL<br>SEQ ID NO: 74 |
| LILRB1 intracellular domain | RHRRQGKHWTSTQRKADFQHPAGAVGPEPTDRGLQWRS SPAADAQEENLYAAVKHTQPEDGVEMDTRSPHDEDPQAV TYAEVKHSRPRREMASPPSPLSGEFLDTKDRQAEEDRQM DTEAAASEAPQDVTYAQLHSLTLRREATEPPPSQEGPSP AVPSIYATLAIH<br>SEQ ID NO: 70 |
| ITIM1 | NLYAAV<br>SEQ ID NO: 56 |
| ITIM2 | VTYAEV<br>SEQ ID NO: 57 |
| ITIM3 | VTYAQL<br>SEQ ID NO: 58 |
| ITIM4 | SIYATL<br>SEQ ID NO: 59 |
| ITIM1-2 | NLYAAVKHTQPEDGVEMDTRSPHDEDPQAVTYAEV<br>SEQ ID NO: 60 |
| ITIM2-3 | VTYAEVKHSRPRREMASPPSPLSGEFLDTKDRQAEED RQMDTEAAASEAPQDVTYAQL<br>SEQ ID NO: 61 |
| ITIM3-4 | VTYAQLHSLTLRREATEPPPSQEGPSPAVPSIYATL<br>SEQ ID NO: 62 |
| ITIM1-3 | NLYAAVKHTQPEDGVEMDTRSPHDEDPQAVTYAEVKHS RPRREMASPPSPLSGEFLDTKDRQAEEDRQMDTEAAAS EAPQDVTYAQL<br>SEQ ID NO: 63 |
| ITIM2-4 | VTYAEVKHSRPRREMASPPSPLSGEFLDTKDRQAEEDRQ MDTEAAASEAPQDVTYAQLHSLTLRREATEPPPSQEGPS PAVPSIYATL<br>SEQ ID NO: 64 |
| ITIM1-4 | NLYAAVKHTQPEDGVEMDTRSPHDEDPQAVTYAEVKHS RPRREMASPPSPLSGEFLDTKDRQAEEDRQMDTEAAAS EAPQDVTYAQLHSLTLRREATEPPPSQEGPSPAVP SIYATL<br>SEQ ID NO: 65 |
| D3D4 domain | YGSQSSKPYLLTHPSDPLEL<br>SEQ ID NO: 66 |
| Short hinge | VVSGPSGGPSSPTTGPTSTSGPEDQPLTPTGSDPQSGL GRHLG<br>SEQ ID NO: 67 |
| Hinge (iTIM hinge) | YGSQSSKPYLLTHPSDPLELVVSGPSGGPSSPTTGPTS TSGPEDQPLTPTGSDPQSGLGRHLGV<br>(SEQ ID NO: 81) |
| Short hinge 2 | VVSGPSGGPSSPTTGPTSTSGPEDQPLTPTGSDPQS GLGRHLGV (SEQ ID NO: 82) |
| Long hinge 1 | AGSGGSGGSGGSPVPSTPPTSPSTPPTPSPSGGSGNSS GSGGSPVPSTPPTPSPSTPPTPSPSASV<br>(SEQ ID NO: 83) |
| Long hinge 2 | AGSGGSGGSGGSPVPSTPPTNSSSTPPTPSPSPVPSTPP TNSSSTPPTPSPSPVPSTPPTNSSSTPPTPSPSASV<br>(SEQ ID NO: 84) |

TABLE 9-continued

Polypeptide sequences for illustrative LILRB1-based inhibitory receptors

| Name | Sequence |
|---|---|
| 2X short hinge | VVSGPSGGPSSPTTGPTSTSGPEDQPLTPTGSDPQSGL GRHVVSGPSGGPSSPTTGPTSTSGPEDQPLTPTGSDPQ SGLGRHLGV SEQ ID NO: 91 |
| Hinge (truncated) | TTGPTSTSGPEDQPLTPTGSDPQSGLGRHLGV (SEQ ID NO: 90) |
| Hinge-transmembrane | YGSQSSKPYLLTHPSDPLELVVSGPSGGPSSPTTGPT STSGPEDQPLTPTGSDPQSGLGRHLGVVIGILVAVIL LLLLLLLLFLIL SEQ ID NO: 68 |
| Transmembrane-intracellular domain. | VVIGILVAVILLLLLLLLLFLILRHRRQGKHWTSTQRKA DFQHPAGAVGPEPTDRGLQWRSSPAADAQEENLYAAVKH TQPEDGVEMDTRSPHDEDPQAVTYAEVKHSRPRREMASP PSPLSGEFLDTKDRQAEEDRQMDTEAAASEAPQDVTYAQ LHSLTLRREATEPPPSQEGPSPAVPSIYATLAIH SEQ ID NO: 69 |

Exemplary inhibitory receptors of the disclosure comprise the scFv specific to any of HLA-A, HLA-B or HLA-C non-target antigens, the sequences of which are set forth in Table 5, fused to the N terminus a LILRB1 hinge, transmembrane and intracellular domain. In some embodiments, the LILRB1 hinge comprises a sequence of SEQ ID NO: 73, the LILRB1 transmembrane domain comprises a sequence of SEQ ID NO: 74, and the LILRB1 intracellular domain comprises a sequence of SEQ ID NO: 70. For example, the second, inhibitory receptor comprises an scFv sequence of Table 5 fused to the N terminus of SEQ ID NO: 71.

As a further example, the non-target antigen comprises HLA-A*02, and the second inhibitory receptor comprises a sequence of: DVLMTQTPLSLPVSLGDQASISCRSSQSIVHSNGN-TYLEWYLQKPGQSPKLLIYKVSNRFSGVPDRFSGSGSGTDFTL KISRVEAE-DLGVYYCFQGSHVPRTSGGGTKLEIKGGGSGGGGSGGGGSGGQVQLQQSGPELVKPGASVRISCKASGYTFTSYHIHWVKQRPGQGLEWIGWIYPGNVN-TEYNEKFKGKATLTADKSSSTAYMHLSSLTSED-SAVYFCAREEI TYAMDYWGQGTSVTVSSYGSQSSKPYLLTHPSDPLELVVSGPSGGPSSPTTGPTSTSG-PEDQPLTPTGSDPQSGLG RHLGVVIGILVA-VILLLLLLLLLFLILRHRRQGKHWTSTQRKADFQH-PAGAVGPEPTDRGLQWRSSPAADAQEENLY AAVKHTQPEDGVEMDTRSPHDEDPQAVTY-AEVKHSRPRREMASPPSPLSGE-FLDTKDRQAEEDRQMDTEAAAS EAPQDVTYAQLHSLTLRREATEPPPSQEGPSPAVPSI-YATLAIH (SEQ ID NO: 348), or a sequence having at least 90%, at least 95%, at least 97% or at least 99% identity thereto. In some embodiments, the non-target antigen comprises HLA-A*02 and the second inhibitory receptor comprises a sequence of SEQ ID NO: 348.

Polynucleotides and Vectors

The disclosure provides polynucleotides encoding the sequence(s) of the first and second receptors of the disclosure. The disclosure provides immune cells comprising the polynucleotides and vectors described herein.

In some embodiments, the sequence of the first and/or second receptor is operably linked to a promoter. In some embodiments, the sequence encoding the first receptor is operably linked to a first promoter, and the sequence encoding the second receptor is operably linked to a second promoter.

The disclosure provides vectors comprising the polynucleotides described herein.

In some embodiments, the first receptor is encoded by a first vector and the second receptor is encoded by a second vector. In some embodiments, both receptors are encoded by a single vector. In some embodiments, the first and/or second vector comprises an shRNA, for example a B2M shRNA.

In some embodiments, both receptors are encoded by a single vector. In some embodiments the vector comprises an shRNA, for example a B2M shRNA.

In some embodiments, the first and second receptors are encoded by a single vector. Methods of encoding multiple polypeptides using a single vector will be known to persons of ordinary skill in the art, and include, inter alia, encoding multiple polypeptides under control of different promoters, or, if a single promoter is used to control transcription of multiple polypeptides, use of sequences encoding internal ribosome entry sites (IRES) and/or self-cleaving peptides. Exemplary self-cleaving peptides include T2A, P2A, E2A and F2A self-cleaving peptides. In some embodiments, the T2A self-cleaving peptide comprises a sequence of EGRGSLLTCGDVEENPGP (SEQ ID NO: 764). In some embodiments, the P2A self-cleaving peptide comprises a sequence of ATNFSLLKQAGDVEENPGP (SEQ ID NO: 765). In some embodiments, the E2A self-cleaving peptide comprises a sequence of QCTNYALLKLAGDVESNPGP (SEQ ID NO: 766). In some embodiments, the F2A self-cleaving peptide comprises a sequence of VKQTLNFDLLKLAGDVESNPGP (SEQ ID NO: 767). In some embodiments, the T2A self-cleaving peptide comprises a sequence of EGRGSLLTCGDVEENPGP (SEQ ID NO: 764). Any of the foregoing can also include an N terminal GSG linker. For example, a T2A self-cleaving peptide can also comprise a sequence of GSGEGRGSLLTCGDVEENPGP (SEQ ID NO: 351), which can be encoded by a sequence of GGATCCG-GAGAGGGCAGAGGCAGCCTGCTGA-CATGTGGCGACGTGGAAGAGAA CCCTGGCCCC (SEQ ID NO: 768).

In some embodiments, the vector is an expression vector, i.e. for the expression of the first and/or second receptor in a suitable cell.

Vectors derived from retroviruses such as the lentivirus are suitable tools to achieve long-term gene transfer since they allow long-term, stable integration of a transgene and its propagation in daughter cells. Lentiviral vectors have the added advantage over vectors derived from onco-retroviruses such as murine leukemia viruses in that they can transduce non-proliferating cells, such as hepatocytes. They also have the added advantage of low immunogenicity.

The expression of natural or synthetic nucleic acids encoding receptors is typically achieved by operably linking a nucleic acid encoding the receptor or portions thereof to a promoter, and incorporating the construct into an expression vector. The vectors can be suitable for replication and integration eukaryotes. Typical cloning vectors contain transcription and translation terminators, initiation sequences, and promoters useful for regulation of the expression of the desired nucleic acid sequence.

The polynucleotides encoding the receptors can be cloned into a number of types of vectors. For example, the polynucleotides can be cloned into a vector including, but not limited to a plasmid, a phagemid, a phage derivative, an animal virus, and a cosmid. Vectors of particular interest include expression vectors, replication vectors, probe generation vectors, and sequencing vectors.

Further, the expression vector may be provided to cells, such as immune cells, in the form of a viral vector. Viral vector technology is well known in the art and is described, for example, in Sambrook et al. (2001, Molecular Cloning: A Laboratory Manual, Cold Spring Harbor Laboratory, New York), and in other virology and molecular biology manuals. Viruses, which are useful as vectors include, but are not limited to, retroviruses, adenoviruses, adeno-associated viruses, herpes viruses, and lentiviruses. In general, a suitable vector contains an origin of replication functional in at least one organism, a promoter sequence, convenient restriction endonuclease sites, and one or more selectable markers, (e.g., WO 01/96584; WO 01/29058; and U.S. Pat. No. 6,326,193).

A number of viral based systems have been developed for gene transfer into mammalian cells. For example, retroviruses provide a convenient platform for gene delivery systems. A selected gene can be inserted into a vector and packaged in retroviral particles using techniques known in the art. The recombinant virus can then be isolated and delivered to cells of the subject either in vivo or ex vivo. A number of retroviral systems are known in the art. In some embodiments, adenovirus vectors are used. A number of adenovirus vectors are known in the art. In one embodiment, lentivirus vectors are used.

Additional promoter elements, e.g., enhancers, regulate the frequency of transcriptional initiation. Typically, these are located in the region 30-110 basepairs (bp) upstream of the start site, although a number of promoters have recently been shown to contain functional elements downstream of the start site as well. The spacing between promoter elements frequently is flexible, so that promoter function is preserved when elements are inverted or moved relative to one another. In the thymidine kinase (tk) promoter, the spacing between promoter elements can be increased to 50 bp apart before activity begins to decline. Depending on the promoter, it appears that individual elements can function either cooperatively or independently to activate transcription.

One example of a suitable promoter is the immediate early cytomegalovirus (CMV) promoter sequence. This promoter sequence is a strong constitutive promoter sequence capable of driving high levels of expression of any polynucleotide sequence operatively linked thereto. Another example of a suitable promoter is Elongation Growth Factor-1α (EF-1α). However, other constitutive promoter sequences may also be used, including, but not limited to the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, a U6 promoter, as well as human gene promoters such as, but not limited to, the actin promoter, the myosin promoter, the hemoglobin promoter, and the creatine kinase promoter. Further, the disclosure should not be limited to the use of constitutive promoters. Inducible promoters are also contemplated as part of the disclosure. The use of an inducible promoter provides a molecular switch capable of turning on expression of the polynucleotide sequence which it is operatively linked when such expression is desired, or turning off the expression when expression is not desired. Examples of inducible promoters include, but are not limited to a metallothionine promoter, a glucocorticoid promoter, a progesterone promoter, and a tetracycline promoter.

In order to assess the expression of a receptor, the expression vector to be introduced into a cell can also contain either a selectable marker gene or a reporter gene or both to facilitate identification and selection of expressing cells from the population of cells sought to be transfected or infected through viral vectors. In other aspects, the selectable marker may be carried on a separate piece of DNA and used in a co-transfection procedure. Both selectable markers and reporter genes may be flanked with appropriate regulatory sequences to enable expression in the host cells. Useful selectable markers include, for example, antibiotic-resistance genes, such as neo and the like.

Reporter genes are used for identifying potentially transfected or transduced cells and for evaluating the functionality of regulatory sequences. In general, a reporter gene is a gene that is not present in or expressed by the recipient organism or tissue and that encodes a polypeptide whose expression is manifested by some easily detectable property, e.g., enzymatic activity. Expression of the reporter gene is assayed at a suitable time after the DNA has been introduced into the recipient cells. Suitable reporter genes may include genes encoding luciferase, beta-galactosidase, chloramphenicol acetyl transferase, secreted alkaline phosphatase, or the green fluorescent protein gene (e.g., Ui-Tei et al., 2000 FEBS Letters 479: 79-82). Suitable expression systems are well known and may be prepared using known techniques or obtained commercially. In general, the construct with the minimal 5' flanking region showing the highest level of expression of reporter gene is identified as the promoter. Such promoter regions may be linked to a reporter gene and used to evaluate agents for the ability to modulate promoter-driven transcription.

Methods of introducing and expressing genes into a cell are known in the art. In the context of an expression vector, the vector can be readily introduced into a host cell, e.g., mammalian, bacterial, yeast, or insect cell by any method in the art. For example, the expression vector can be transferred into a host cell by physical, chemical, or biological means.

Physical methods for introducing a polynucleotide into a host cell include calcium phosphate precipitation, lipofection, particle bombardment, microinjection, electroporation, and the like. Methods for producing cells comprising vectors and/or exogenous nucleic acids are well-known in the art. See, for example, Sambrook et al. (2001, Molecular Cloning: A Laboratory Manual, Cold Spring Harbor Laboratory, New York). One method for the introduction of a polynucleotide into a host cell is calcium phosphate transfection.

Biological methods for introducing a polynucleotide of interest into a host cell include the use of DNA and RNA vectors. Viral vectors, and especially retroviral vectors, have become the most widely used method for inserting genes into mammalian, e.g., human cells. Other viral vectors can be derived from lentivirus, poxviruses, herpes simplex virus I, adenoviruses and adeno-associated viruses, and the like. See, for example, U.S. Pat. Nos. 5,350,674 and 5,585,362.

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle).

Regardless of the method used to introduce exogenous nucleic acids into a host cell or otherwise expose a cell to the inhibitor of the present disclosure, in order to confirm the presence of the recombinant DNA sequence in the host cell, a variety of assays may be performed. Such assays include, for example, "molecular biological" assays well known to those of skill in the art, such as Southern and Northern blotting, RT-PCR and PCR; "biochemical" assays, such as detecting the presence or absence of a particular peptide, e.g., by immunological means (ELISAs and Western blots) or by assays described herein to identify agents falling within the scope of the disclosure.

Immune Cells

The disclosure provides immune cells comprising the receptors, vectors and polynucleotides described herein. 04051 In some embodiments, the immune cells comprise: (a) first receptor, comprising a first extracellular ligand binding domain specific to a target antigen selected from: (i) a cancer cell-specific antigen, or a peptide antigen thereof in a complex with a major histocompatibility complex class I (MHC-I); or (ii) MSLN, or a peptide antigen thereof in a complex with a major histocompatibility complex class I (MHC-I); and (b) a second receptor, comprising a second extracellular ligand binding specific to a non-target antigen selected from intercellular adhesion molecule 1 (ICAM1), catechol-O-methyltransferase (COMT), C—X—C motif chemokine ligand 16 (CXCL16), leucine rich repeat neuronal 4 (LRRN4) and uroplakin 3B UPK3B, or an antigen peptide thereof in a complex with a major histocompatibility complex class I (MHC-I), or HLA-A*02. In some embodiments, the first receptor is a CAR or TCR. In some embodiments, the second receptor is an inhibitory receptor, such as an inhibitory chimeric antigen receptor or TCR.

The disclosure provides immune cells comprising a first receptor comprising a sequence of SEQ ID NO: 303, and second receptor comprising a sequence of SEQ ID NO: 348, or sequences having at least 90%, at least 95%, at least 97% or at least 99% identity thereto. In some embodiments, the immune cells comprise an shRNA encoded by a sequence comprising SEQ ID NO: 349 or 350, or a sequence having at least 80%, at least 90%, or at least 95% identity thereto. In some embodiments, the immune cells comprise first receptor comprising a sequence of SEQ ID NO: 303, a second receptor comprising a sequence of SEQ ID NO: 348, and a sequence encoding an shRNA comprising a sequence of SEQ ID NO: 349 or 350. In some embodiments, the first receptor and second receptor are encoded by a single polynucleotide, and wherein the sequences encoding the first and second receptors are separated by a sequence encoding a self-cleaving polypeptide. In some embodiments, the self-cleaving polypeptide comprises a T2A self-cleaving polypeptide comprising a sequence of GSGEGRGSLLTCGD-VEENPGP (SEQ ID NO: 351).

As used herein, the term "immune cell" refers to a cell involved in the innate or adaptive (acquired) immune systems. Exemplary innate immune cells include phagocytic cells such as neutrophils, monocytes and macrophages, Natural Killer (NK) cells, polymophonuclear leukocytes such as neutrophils eosinophils and basophils and mononuclear cells such as monocytes, macrophages and mast cells. Immune cells with roles in acquired immunity include lymphocytes such as T-cells and B-cells.

As used herein, a "T-cell" refers to a type of lymphocyte that originates from a bone marrow precursor that develops in the thymus gland. There are several distinct types of T-cells which develop upon migration to the thymus, which include, helper CD4+ T-cells, cytotoxic CD8+ T cells, memory T cells, regulatory CD4+ T-cells and stem memory T-cells. Different types of T-cells can be distinguished by the ordinarily skilled artisan based on their expression of markers. Methods of distinguishing between T-cell types will be readily apparent to the ordinarily skilled artisan.

In some embodiments, the first receptor and the second receptor together specifically activate the immune cell in the presence of the target cell.

In some embodiments, the immune cell is CD4+, CD8+, a gamma delta T cell, an invariant T cells, an iNK cell, a NK cell, a macrophages, or combinations thereof. In some embodiments, the immune cell is a gamma delta (γδ) T cell. In some embodiments, the immune cell is an invariant T cell. In some embodiments, the immune cell is an invariant natural killer T cell (iNKT cell). In some embodiments, the immune cell is a T cell. In some embodiments, the immune cell is a B cell. In some embodiments, the immune cell is a Natural Killer (NK) cell. In some embodiments, the immune cell is CD8−. In some embodiments, the immune cell is CD8+. In some embodiments, the immune cell is CD4+. In some embodiments, the immune cell is CD4−. In some embodiments, the immune cell is CD8−/CD4+. In some embodiments, the immune cell is a CD8+CD4− T cell.

In some embodiments, the immune cell is non-natural. In some embodiments, the immune cell is isolated.

Methods transforming populations of immune cells, such as T cells, with the vectors of the instant disclosure will be readily apparent to the person of ordinary skill in the art. For example, CD3+ T cells can be isolated from PBMCs using a CD3+ T cell negative isolation kit (Miltenyi), according to manufacturer's instructions. T cells can be cultured at a density of 1×10^6 cells/mL in X-Vivo 15 media supplemented with 5% human A/B serum and 1% Pen/strep in the presence of CD3/28 Dynabeads (1:1 cell to bead ratio) and 300 Units/mL of IL-2 (Miltenyi). After 2 days, T cells can be transduced with viral vectors, such as lentiviral vectors using methods known in the art. In some embodiments, the viral vector is transduced at a multiplicity of infection (MOI) of 5. Cells can then be cultured in IL-2 or other cytokines such as combinations of IL-7/15/21 for an additional 5 days prior to enrichment. Methods of isolating and culturing other populations of immune cells, such as B cells, or other populations of T cells, will be readily apparent to the person of ordinary skill in the art. Although this method outlines a potential approach it should be noted that these methodologies are rapidly evolving. For example excellent viral transduction of peripheral blood mononuclear cells can be achieved after 5 days of growth to generate a >99% CD3+ highly transduced cell population.

Methods of activating and culturing populations of T cells comprising the TCRs, CARs, inhibitory receptors, receptors or vectors encoding same, will be readily apparent to the person of ordinary skill in the art.

Whether prior to or after genetic modification of T cells to express a TCR, the T cells can be activated and expanded generally using methods as described, for example, in U.S. Pat. Nos. 6,352,694; 6,534,055; 6,905,680; 6,692,964; 5,858,358; 6,887,466; 6,905,681; 7,144,575; 7,067,318; 7,172,869; 7,232,566; 7,175,843; 5,883,223; 6,905,874; 6,797,514; 6,867,041, 10040846; and U.S. Pat. Appl. Pub. No. 2006/0121005.

In some embodiments, T cells of the instant disclosure are expanded and activated in vitro. Generally, the T cells of the instant disclosure are expanded in vitro by contact with a surface having attached thereto an agent that stimulates a CD3/TCR complex associated signal and a ligand that stimulates a co-stimulatory molecule on the surface of the T cells. In particular, T cell populations may be stimulated as described herein, such as by contact with an anti-CD3 antibody. For co-stimulation of an accessory molecule on the surface of the T cells, a ligand that binds the accessory molecule is used. For example, a population of T cells can be contacted with an anti-CD3 antibody and an anti-CD28 antibody, under conditions appropriate for stimulating proliferation of the T cells. To stimulate proliferation of either CD4+ T cells or CD8+ T cells, an anti-CD3 antibody and an anti-CD28 antibody can be used. Examples of an anti-CD28 antibody include 9.3, B-T3, XR-CD28 (Diaclone, Besancon, France) can be used as can other methods commonly known in the art (Berg et al., Transplant Proc. 30(8):3975-3977, 1998; Haanen et al., J. Exp. Med. 190(9):13191328, 1999; Garland et al., J. Immunol Meth. 227(1-2):53-63, 1999).

In some embodiments, the primary stimulatory signal and the co-stimulatory signal for the T cell may be provided by different protocols. For example, the agents providing each signal may be in solution or coupled to a surface. When coupled to a surface, the agents may be coupled to the same surface (i.e., in "cis" formation) or to separate surfaces (i.e., in "trans" formation). Alternatively, one agent may be coupled to a surface and the other agent in solution. In some embodiments, the agent providing the co-stimulatory signal is bound to a cell surface and the agent providing the primary activation signal is in solution or coupled to a surface. In certain embodiments, both agents can be in solution. In another embodiment, the agents may be in soluble form, and then cross-linked to a surface, such as a cell expressing Fc receptors or an antibody or other binding agent which will bind to the agents. In this regard, see for example, U.S. Patent Application Publication Nos. 20040101519 and 20060034810 for artificial antigen presenting cells (aAPCs) that are contemplated for use in activating and expanding T cells in the present disclosure.

In some embodiments, the two agents are immobilized on beads, either on the same bead, i.e., "cis," or to separate beads, i.e., "trans." By way of example, the agent providing the primary activation signal is an anti-CD3 antibody or an antigen-binding fragment thereof and the agent providing the co-stimulatory signal is an anti-CD28 antibody or antigen-binding fragment thereof; and both agents are co-immobilized to the same bead in equivalent molecular amounts. In one embodiment, a 1:1 ratio of each antibody bound to the beads for CD4+ T cell expansion and T cell growth is used. In some embodiments, the ratio of CD3:CD28 antibody bound to the beads ranges from 100:1 to 1:100 and all integer values there between. In one aspect of the present disclosure, more anti-CD28 antibody is bound to the particles than anti-CD3 antibody, i.e., the ratio of CD3:CD28 is less than one. In certain embodiments of the disclosure, the ratio of anti CD28 antibody to anti CD3 antibody bound to the beads is greater than 2:1.

Ratios of particles to cells from 1:500 to 500:1 and any integer values in between may be used to stimulate T cells or other target cells. As those of ordinary skill in the art can readily appreciate, the ratio of particles to cells may depend on particle size relative to the target cell. For example, small sized beads could only bind a few cells, while larger beads could bind many. In certain embodiments the ratio of cells to particles ranges from 1:100 to 100:1 and any integer values in-between and in further embodiments the ratio comprises 1:9 to 9:1 and any integer values in between, can also be used to stimulate T cells. In some embodiments, a ratio of 1:1 cells to beads is used. One of skill in the art will appreciate that a variety of other ratios may be suitable for use in the present disclosure. In particular, ratios will vary depending on particle size and on cell size and type.

In further embodiments of the present disclosure, the cells, such as T cells, are combined with agent-coated beads, the beads and the cells are subsequently separated, and then the cells are cultured. In an alternative embodiment, prior to culture, the agent-coated beads and cells are not separated but are cultured together. In a further embodiment, the beads and cells are first concentrated by application of a force, such as a magnetic force, resulting in increased ligation of cell surface markers, thereby inducing cell stimulation.

By way of example, cell surface proteins may be ligated by allowing paramagnetic beads to which anti-CD3 and anti-CD28 are attached to contact the T cells. In one embodiment the cells (for example, CD4+ T cells) and beads (for example, DYNABEADS CD3/CD28 T paramagnetic beads at a ratio of 1:1) are combined in a buffer. Again, those of ordinary skill in the art can readily appreciate any cell concentration may be used. In certain embodiments, it may be desirable to significantly decrease the volume in which particles and cells are mixed together (i.e., increase the concentration of cells), to ensure maximum contact of cells and particles. For example, in one embodiment, a concentration of about 2 billion cells/ml is used. In another embodiment, greater than 100 million cells/ml is used. In a further embodiment, a concentration of cells of 10, 15, 20, 25, 30, 35, 40, 45, or 50 million cells/ml is used. In yet another embodiment, a concentration of cells from 75, 80, 85, 90, 95, or 100 million cells/ml is used. In further embodiments, concentrations of 125 or 150 million cells/ml can be used. In some embodiments, cells that are cultured at a density of $1 \times 10^6$ cells/mL are used.

In some embodiments, the mixture may be cultured for several hours (about 3 hours) to about 14 days or any hourly integer value in between. In another embodiment, the beads and T cells are cultured together for 2-3 days. Conditions appropriate for T cell culture include an appropriate media (e.g., Minimal Essential Media or RPMI Media 1640 or, X-vivo 15, (Lonza)) that may contain factors necessary for proliferation and viability, including serum (e.g., fetal bovine or human serum), interleukin-2 (IL-2), insulin, IFN- γ, IL-4, IL-7, GM-CSF, IL-10, IL-12, IL-15, TGFβ, and TNF-α or any other additives for the growth of cells known to the skilled artisan. Other additives for the growth of cells include, but are not limited to, surfactant, plasmanate, and reducing agents such as N-acetyl-cysteine and 2-mercapto-ethanol. Media can include RPMI 1640, AIM-V, DMEM, MEM, α-MEM, F-12, X-Vivo 15, and X-Vivo 20, Optimizer, with added amino acids, sodium pyruvate, and vitamins, either serum-free or supplemented with an appropriate amount of serum (or plasma) or a defined set of hormones, and/or an amount of cytokine(s) sufficient for the growth and expansion of T cells. In some embodiments, the media comprises X-VIVO-15 media supplemented with 5% human A/B serum, 1% penicillin/streptomycin (pen/strep) and 300 Units/ml of IL-2 (Miltenyi).

The T cells are maintained under conditions necessary to support growth, for example, an appropriate temperature (e.g., 37° C.) and atmosphere (e.g., air plus 5% CO2).

In some embodiments, the T cells comprising TCRs, CARs and inhibitory receptors of the disclosure are autologous. Prior to expansion and genetic modification, a source of T cells is obtained from a subject. Immune cells such as T cells can be obtained from a number of sources, including peripheral blood mononuclear cells, bone marrow, lymph node tissue, cord blood, thymus tissue, tissue from a site of infection, ascites, pleural effusion, spleen tissue, and tumors. In certain embodiments of the present disclosure, any number of T cell lines available in the art, may be used. In certain embodiments of the present disclosure, T cells can be obtained from a unit of blood collected from a subject using any number of techniques known to the skilled artisan, such as Ficoll™ separation.

In some embodiments, cells from the circulating blood of an individual are obtained by apheresis. The apheresis product typically contains lymphocytes, including T cells, monocytes, granulocytes, B cells, other nucleated white blood cells, red blood cells, and platelets. In some embodiments, the cells collected by apheresis may be washed to remove the plasma fraction and to place the cells in an appropriate buffer or media for subsequent processing steps. In some embodiments, the cells are washed with phosphate buffered saline (PBS). In alternative embodiments, the wash solution lacks calcium and may lack magnesium or may lack many if not all divalent cations. As those of ordinary skill in the art would readily appreciate a washing step may be accomplished by methods known to those in the art, such as by using a semi-automated "flow-through" centrifuge (for example, the Cobe 2991 cell processor, the Baxter Cyto-Mate, or the Haemonetics Cell Saver 5) according to the manufacturer's instructions. After washing, the cells may be resuspended in a variety of biocompatible buffers, such as, for example, Ca2+-free, Mg2+-free PBS, PlasmaLyte A, or other saline solution with or without buffer. Alternatively, the undesirable components of the apheresis sample may be removed and the cells directly resuspended in culture media.

In some embodiments, immune cells such as T cells are isolated from peripheral blood lymphocytes by lysing the red blood cells and depleting the monocytes, for example, by centrifugation through a PERCOLL™ gradient or by counterflow centrifugal elutriation. Specific subpopulations of immune cells, such as T cells, B cells, or CD4+ T cells can be further isolated by positive or negative selection techniques. For example, in one embodiment, T cells are isolated by incubation with anti-CD4-conjugated beads, for a time period sufficient for positive selection of the desired T cells.

Enrichment of an immune cell population, such as a T cell population, by negative selection can be accomplished with a combination of antibodies directed to surface markers unique to the negatively selected cells. One method is cell sorting and/or selection via negative magnetic immune-adherence or flow cytometry that uses a cocktail of monoclonal antibodies directed to cell surface markers present on the cells negatively selected. For example, to enrich for CD4+ cells by negative selection, a monoclonal antibody cocktail typically includes antibodies to CD 14, CD20, CD 11b, CD 16, HLA-DR, and CD8.

For isolation of a desired population of immune cells by positive or negative selection, the concentration of cells and surface (e.g., particles such as beads) can be varied. In certain embodiments, it may be desirable to significantly decrease the volume in which beads and cells are mixed together (i.e., increase the concentration of cells), to ensure maximum contact of cells and beads.

In some embodiments, the cells may be incubated on a rotator for varying lengths of time at varying speeds at either 2-10° C. or at room temperature.

T cells for stimulation, or PBMCs from which immune cells such as T cells are isolated, can also be frozen after a washing step. Wishing not to be bound by theory, the freeze and subsequent thaw step provides a more uniform product by removing granulocytes and to some extent monocytes in the cell population. After the washing step that removes plasma and platelets, the cells may be suspended in a freezing solution. While many freezing solutions and parameters are known in the art and will be useful in this context, one method involves using PBS containing 20% DMSO and 8% human serum albumin, or culture media containing 10% Dextran 40 and 5% Dextrose, 20% Human Serum Albumin and 7.5% DMSO, or 31.25% Plasmalyte-A, 31.25% Dextrose 5%, 0.45% NaCl, 10% Dextran 40 and 5% Dextrose, 20% Human Serum Albumin, and 7.5% DMSO or other suitable cell freezing media containing for example, Hespan and PlasmaLyte A, the cells then are frozen to −80° C. at a rate of 1° per minute and stored in the vapor phase of a liquid nitrogen storage tank. Other methods of controlled freezing may be used as well as uncontrolled freezing immediately at −20° C. or in liquid nitrogen.

The disclosure provides an immune cell expressing the activator and/or blocker receptors described herein, wherein the immune cell has reduced expression and/or function the major histocompatibility (MHC) class I complex.

In some embodiments, the immune cell is autologous. For example, the immune cells is isolated or derived from same subject who will receive the cell as part of a therapeutic regimen. It can be advantageous to modify autologous immune cells to have reduced expression and/or function of MHC class I with the blocker receptor is specific to an MHC class I antigen. Without wishing to be bound by theory, modification of autologous immune cells to have reduced expression and/or function of MHC class I reduces binding of the blocker receptor by MHC class I expressed by the immune cells, either in cis or in trans.

In some embodiments, the immune cell is all allogeneic. Allogeneic immune cells can be derived from a donor other than the subject to which the immune cells will be administered. Allogeneic immune cells have been commonly referred to in cell therapy as "off-the-shelf" or "universal" because of the possibility for allogeneic cells to be prepared and stored for use in subjects of a variety of genotypes.

Any suitable methods of reducing expression and/or function the MHC class I complex are envisaged as within the scope of the instant disclosure, and include, inter alia, expression of interfering RNAs that knock down one or more RNAs encoding MHC class I components, or modifications of genes encoding MHC class I components.

The major histocompatibility complex (MHC) is a locus on the vertebrate genome that encodes a set of polypeptides required for the adaptive immune system. Among these are MHC class I polypeptides that include HLA-A, HLA-B, and HLA-C and alleles thereof. MHC class I alleles are highly polymorphic and expressed in all nucleated cells. MHC class I polypeptides encoded by HLA-A, HLA-B, and HLA-C and alleles thereof form heterodimers with β2 microglobulin (B2M) and present in complex with antigens on the surface of cells. As referred to herein, an MHC class I gene or polypeptide may refer to any polypeptide found in the MHC or the corresponding gene encoding said polypeptide. In some embodiments, the immune cells of the disclosure are inactivated by an inhibitor ligand comprising an MHC class I polypeptide, e.g. HLA-A, HLA-B, and HLA-C and alleles thereof. HLA-A alleles can be, for example and without limitation, HLA-A*02, HLA-A*02:01, HLA-A*02:01:01, HLA-A*02:01:01:01, and/or any gene that encodes protein identical or similar to HLA-A*02 protein. Thus, to prevent autocrine signaling/binding as described herein, it is desirable to eliminate or reduce expression of polypeptides encoded by HLA-A, HLA-B, and HLA-C and alleles thereof in the immune cells.

Immune Cells with Reduced MHC Class I Polypeptide Expression

In some embodiments, the immune cells described herein are modified to inactivate, or reduce or eliminate expression or function of an endogenous gene encoding an allele of an endogenous MHC class I polypeptide. In some embodiments, the gene encoding the MHC class I polypeptide is HLA-A, HLA-B, and/or HLA-C. HLA-A, HLA-B and HLA-C are encoded by the HLA-A, HLA-B and HLA-C loci. Each of HLA-A, HLA-B and HLA-C includes many variant alleles, all of which are envisaged as within the scope of the instant disclosure. In some embodiments, the gene encoding the MHC class I polypeptide is HLA-A. In some embodiments, the gene encoding the MHC class I polypeptide is HLA-A*02. In some embodiments, the gene encoding the MHC class I polypeptide is HLA-A*02:01. In some embodiments, the gene encoding the MHC class I polypeptide is HLA-A*02:01:01. In some embodiments, the gene encoding the MHC class I polypeptide is HLA-A*02:01:01:01.

In some embodiments, the genetically engineered immune cells described herein are modified to reduce or eliminate expression of the B2M gene product. The beta-2 microglobulin (B2M) gene encodes a protein that associates with the major histocompatibility complex (MHC) class I, i.e. MHC-I complex. The MHC-I complex is required for presentation of antigens on the cell surface. The MHC-I complex is disrupted and non-functional when the B2M is deleted (Wang D et al. Stem Cells Transl Med. 4:1234-1245 (2015)). Furthermore, the B2M gene can be disrupted with high efficiency using gene editing techniques known in the art (Ren et al. Clin. Cancer Res. 23:2255-2266 (2017)). Reducing or eliminating B2M can reduce, or eliminate functional MHC I on the surface of the immune cell.

The disclosure provides gene editing systems for editing an endogenous target gene in an immune cell. The disclosure provides interfering RNAs specific to sequences of target genes. Gene editing systems such as CRISPR/Cas systems, TALENs and zinc fingers can be used to generate double strand breaks, which, through gene repair mechanisms such as homology directed repair or non-homologous end joining (NHEJ), can be used to introduce mutations. NHEJ after resection of the ends of the break, or improper end joining, can be used to introduce deletions. In some embodiments, the target gene comprises a gene encoding a subunit of the MHC-I complex.

Target gene sequences include, but are not limited to, promoters, enhancers, introns, exons, intron/exon junctions, transcription products (pre-mRNA, mRNA, and splice variants), and/or 3' and 5' untranslated regions (UTRs). Any gene element or combination of gene elements may be targeted for the purpose of genetic editing in the immune cells described herein. Modifications to the target genes can be accomplished using any method known in the art to edit the target gene that results in altered or disrupted expression or function the target gene or gene product.

In some embodiments, modifying the gene encoding the MHC class I polypeptide comprises deleting all or a portion of the gene. In some embodiments, modifying the gene encoding the MHC class I polypeptide comprises introducing a mutation in the gene. In some embodiments, the mutation comprises a deletion, insertion, substitution, or frameshift mutation. In some embodiments, modifying the gene comprises using a nucleic acid guided endonuclease.

Gene sequences for the target genes described herein are known in the art. The sequences can be found at public databases, such as NCBI GenBank or the NCBI nucleotide database. Sequences may be found using gene identifiers, for example, the HLA-A gene has NCBI Gene ID: 3105, the HLA-B gene has NCBI Gene ID: 3106, the HLA-C gene has NCBI Gene ID: 3107, and the B2M gene has NCBI Gene ID: 567 and NCBI Reference Sequence: NC 000015.10. Gene sequences may also be found by searching public databases using keywords. For example, HLA-A alleles may be found in the NCBI nucleotide database by searching keywords, "HLA-A*02", "HLA-A*02:01", "HLA-A*02:01:01", or "HLA-A*02:01:01:01." These sequences can be used for targeting in various gene editing techniques known in the art. Table 10 provides non-limiting illustrative sequences of HLA-A allele and B2M gene sequences targeted for modification as described herein.

TABLE 10

| Exemplary Target Gene Sequences | |
| --- | --- |
| B2M mRNA | SEQ ID NO: 769 |
| B2M Gene (GenBank: 567) | SEQ ID NO: 770 |
| HLA-A*02:01:01:01 sequence encoding mRNA | SEQ ID NO: 771 |
| HLA-A*02 (GenBank: LK021978.1) | SEQ ID NO: 772 |

The person of ordinary skill in the art will appreciate that T can be substituted for U to convert an RNA sequence to a DNA sequence and vice versa, and both are envisaged as target gene sequences of the disclosure.

In some embodiments, a target gene is edited in the immune cells described herein using a nucleic acid guided endonuclease. Exemplary nucleic acid guided endonucleases include Class II endonucleases, such as CRISPR/Cas9.

"CRISPR" or "CRISPR gene editing" as used herein refers to a set of clustered regularly interspaced short palindromic repeats, or a system comprising such a set of repeats. "Cas", as used herein, refers to a CRISPR-associated protein. A "CRISPR/Cas" system refers to a system derived from CRISPR and Cas which can be used to silence, knock out, or mutate a target gene. This system is a type of prokaryotic immune system that confers resistance to foreign genetic elements such as plasmids and phages and provides a form of acquired immunity. The CRISPR/Cas system has been modified for use in gene editing. This is accomplished by introducing into the eukaryotic cell a one or more specifically designed guide nucleic acids (gNAs), typically guide RNAs (gRNAs), and an appropriate Cas endonuclease which forms a ribonucleoprotein complex with the gNA. The gNA guides the gNA-endonuclease protein complex to a target genomic location, and the endonuclease introduces strand breakage at the target genomic location. This strand breakage can be repaired by cellular mechanisms such non-homologous end joining (leading to deletions) or homologous repair (which can generate insertions), thereby introducing genetic modifications into the host cell genome.

CRISPR/Cas systems are classified by class and by type. Class 2 systems currently represent a single interference protein that is categorized into three distinct types (types II, V and VI). Any class 2 CRISPR/Cas system suitable for gene editing, for example a type II, a type V or a type VI system, is envisaged as within the scope of the instant disclosure. Exemplary Class 2 type II CRISPR systems include Cas9, Csn2 and Cas4. Exemplary Class 2, type V CRISPR systems include, Cas12, Cas12a (Cpf1), Cas12b (C2c1), Cas12c (C2c3), Cas12d (CasY), Cas12e (CasX), Cas12f, Cas12g, Cas12 h, Cas12i and Cas12k (C2c5). Exemplary Class 2 Type VI systems include Cas13, Cas13a (C2c2) Cas13b, Cas13c and Cas13d.

The CRISPR sequence, sometimes called a CRISPR locus, comprises alternating repeats and spacers. In a naturally-occurring CRISPR, the spacers usually comprise sequences foreign to the bacterium such as a plasmid or phage sequence. As described herein, spacer sequences may also be referred to as "targeting sequences." In CRISPR/Cas systems for a genetic engineering, the spacers are derived from the target gene sequence (the gNA).

An exemplary Class 2 type II CRISPR system relies on the protein Cas9, which is a nuclease with two active cutting sites, one for each strand of the double helix. Combining Cas9 and modified CRISPR locus RNA can be used in a system for gene editing. Pennisi (2013) Science 341: 833-836. In some embodiments, the Cas protein used to modify the immune cells is Cas9.

The CRISPR/Cas system can thus be used to edit a target gene, such as a gene targeted for editing in the immune cells described herein, by adding or deleting a base pair, or introducing a premature stop which thus decreases expression of the target. The CRISPR/Cas system can alternatively be used like RNA interference, turning off a target gene in a reversible fashion. In a mammalian cell, for example, the RNA can guide the Cas protein to a target gene promoter, sterically blocking RNA polymerases.

A Cas protein may be derived from any bacterial or archaeal Cas protein. Any suitable CRISPR/Cas system is envisaged as within the scope of the instant disclosure. In other aspects, Cas protein comprises one or more of Cas1, Cas1B, Cas2, Cas3, Cas4, Cas5, Cas6, Cas7, Cas8, Cas9, Cas10, Cas12a (Cpf1), Cas13, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, CasX, CasY, homologs thereof, or modified versions thereof. In some embodiments, the Cas protein is a Cas9 protein, a Cpf1 protein, a C2c1 protein, a C2c2 protein, a C2c3 protein, Cas3, Cas3-HD, Cas5, Cas7, Cas8, Cas1 0, or combinations or complexes of these. In some embodiments, the Cas protein is a Cas9 protein.

Artificial CRISPR/Cas systems can be generated which inhibit a target gene, using technology known in the art, e.g., that described in U.S. Publication No. 20140068797, and Cong (2013) Science 339: 819-823. Other artificial CRISPR/Cas systems that are known in the art may also be generated which inhibit a target gene, e.g., that described in Tsai (2014) Nature Biotechnol., 32:6 569-576, U.S. Pat. Nos. 8,871,445; 8,865,406; 8,795,965; 8,771,945; and 8,697,359. Methods of designing suitable gNAs for a particular Cas protein will be known by persons of ordinary skill in the art.

The present disclosure provides gene-targeting guide nucleic acids (gNAs) that can direct the activities of an associated polypeptide (e.g., nucleic acid guided endonuclease) to a specific target gene sequence within a target nucleic acid genome. The genome-targeting nucleic acid can be an RNA. A genome-targeting RNA is referred to as a "guide RNA" or "gRNA" herein. A guide RNA can comprise at least a targeting sequence that hybridizes to a target nucleic acid sequence of interest, and a CRISPR repeat sequence. In some Type II systems, the gRNA also comprises a second RNA called the tracrRNA sequence, also referred to herein as a "scaffold" sequence. In the Type II guide RNA (gRNA), the CRISPR repeat sequence and scaffold sequence hybridize to each other to form a duplex. In the Type V guide RNA (gRNA), the crRNA forms a duplex. In both systems, the duplex can bind a site-directed polypeptide, such that the guide RNA and site-directed polypeptide form a complex. The gene-targeting nucleic acid can provide target specificity to the complex by virtue of its association with the site-directed polypeptide. The gene-targeting nucleic acid thus can direct the activity of the site-directed polypeptide.

In some embodiments, the disclosure provides a guide RNA comprising a targeting sequence and a guide RNA scaffold sequence, wherein the targeting sequence is complementary to the sequence of a target gene.

Exemplary guide RNAs include targeting sequences of about 15-20 bases. As is understood by the person of ordinary skill in the art, each gRNA can be designed to include a targeting sequence complementary to its genomic target sequence. For example, each of the targeting sequences, e.g., the RNA version of the DNA sequences presented in Tables 11 and 14, minus the three 3' nucleotides which represent that PAM site, can be put into a single RNA chimera or a crRNA.

The gene targeting nucleic acid can be a double-molecule guide RNA. The gene targeting nucleic acid can be a single-molecule guide RNA. The gene targeting nucleic acid can be any known configuration of guide RNA known in the art, such as, for example, including paired gRNA, or multiple gRNAs used in a single step. Although it is clear from genomic sequences where the coding sequences and splice junctions are, other features required for gene expression may be idiosyncratic and unclear.

A double-molecule guide RNA can comprise two strands of RNA. The first strand comprises a sequence in the 5' to 3' direction, an optional spacer extension sequence, a targeting sequence and a minimum CRISPR repeat sequence. The second strand can comprise a minimum tracrRNA sequence (complementary to the minimum CRISPR repeat sequence), a 3' tracrRNA sequence and an optional tracrRNA extension sequence.

A single-molecule guide RNA (sgRNA) in a Type II system can comprise, in the 5' to 3' direction, an optional spacer extension sequence, a targeting sequence, a minimum CRISPR repeat sequence, a single-molecule guide linker, a minimum tracrRNA sequence, a 3' tracrRNA sequence and an optional tracrRNA extension sequence. The optional tracrRNA extension can comprise elements that contribute additional functionality (e.g., stability) to the guide RNA. The single-molecule guide linker can link the minimum CRISPR repeat and the minimum tracrRNA sequence to form a hairpin structure. The optional tracrRNA extension can comprise one or more hairpins.

In some embodiments, guide RNA or single-molecule guide RNA (sgRNA) can comprise a targeting sequence and a scaffold sequence. In some embodiments, the scaffold sequence is a Cas9 gRNA sequence. In some embodiments, the scaffold sequence is encoded by a DNA sequence that comprises a sequence that shares at least 90%, at least 95%, at least 96%, at least 97%, at least 98%, or at least 99% identity to GTTTTAGAGCTAGAAATAGCAAGT-TAAAATAAGGCT AGTCCGTTATCAACTT-GAAAAAGTGGCACCGAGTCGGTGCTTTTTTT (SEQ ID NO: 773). In some embodiments, the scaffold sequence is encoded by a DNA sequence that comprises GTTT-TAGAGCTAGAAATAGCAAGT-TAAAATAAGGCTAGTCCGTTATCAACTT GAAAAAGTGGCACCGAGTCGGTGCTTTTTTT (SEQ ID NO: 773).

In some embodiments, for example those embodiments where the CRISPR/Cas system is a Cas9 system, the sgRNA can comprise a 20 nucleotide targeting sequence at the 5' end of the sgRNA sequence. The sgRNA can comprise a less than a 20 nucleotide targeting sequence at the 5' end of the sgRNA sequence. The sgRNA can comprise a more than 20 nucleotide targeting sequence at the 5' end of the sgRNA sequence. The sgRNA can comprise a variable length targeting sequence with 17-30 nucleotides at the 5' end of the sgRNA sequence.

Suitable scaffold sequences, and arrangement of scaffold targeting sequences, will depend on choice of endonuclease, and will be known to persons of skill in the art.

A single-molecule guide RNA (sgRNA) in a Type II system, e.g. Cas9, can comprise, in the 5' to 3' direction, a minimum CRISPR repeat sequence and a targeting sequence.

By way of illustration, guide RNAs used in the CRISPR/Cas9 or CRISPR/Cpf1 system, or other smaller RNAs can be readily synthesized by chemical means, as illustrated below and described in the art. While chemical synthetic procedures are continually expanding, purifications of such RNAs by procedures such as high performance liquid chromatography (HPLC, which avoids the use of gels such as PAGE) tends to become more challenging as polynucleotide lengths increase significantly beyond a hundred or so nucleotides. One approach used for generating RNAs of greater length is to produce two or more molecules that are ligated together. Much longer RNAs, such as those encoding a Cas9 or Cpf1 endonuclease, are more readily generated enzymatically. Various types of RNA modifications can be introduced during or after chemical synthesis and/or enzymatic generation of RNAs, e.g., modifications that enhance stability, reduce the likelihood or degree of innate immune response, and/or enhance other attributes, as described in the art.

The targeting sequence of a gRNA hybridizes to a sequence in a target nucleic acid of interest. The targeting sequence of a genome-targeting nucleic acid can interact with a target nucleic acid in a sequence-specific manner via hybridization (i.e., base pairing). The nucleotide sequence of the targeting sequence can vary depending on the sequence of the target nucleic acid of interest.

In a Cas9 system described herein, the targeting sequence can be designed to hybridize to a target nucleic acid that is located 5' of the reverse complement of a PAM of the Cas9 enzyme used in the system. The targeting sequence may perfectly match the target sequence or may have mismatches. Each CRISPR/Cas system protein may have a particular PAM sequence, in a particular orientation and position, that it recognizes in a target DNA. For example, *S. pyogenes* Cas9 recognizes in a target nucleic acid a PAM that comprises the sequence 5'-NRG-3', where R comprises either A or G, where N is any nucleotide and N is immediately 3' of the target nucleic acid sequence targeted by the targeting sequence. Selection of appropriate PAM sequences will be apparent to the person of ordinary skill in the art.

The target sequence is complementary to, and hybridizes with, the targeting sequence of the gRNA. The target nucleic acid sequence can comprise 20 nucleotides. The target nucleic acid can comprise less than 20 nucleotides. The target nucleic acid can comprise more than 20 nucleotides. The target nucleic acid can comprise at least: 5, 10, 15, 16, 17, 18, 19, 20, 21, 22, 23, 24, 25, 30 or more nucleotides. In some embodiments, for example those embodiments where the CRISPR/Cas system is a Cas9 system, the target nucleic acid sequence can comprise 20 nucleotides immediately 5' of the first nucleotide of the reverse complement of the PAM sequence. This target nucleic acid sequence is often referred to as the PAM strand or a target strand, and the complementary nucleic acid sequence is often referred to the non-PAM strand or non-target strand. One of skill in the art would recognize that the targeting sequence hybridizes to the non-PAM strand of the target nucleic acid, see e.g., US20190185849A1.

In some examples, the percent complementarity between the targeting sequence and the target nucleic acid is at least about 30%, at least about 40%, at least about 50%, at least about 60%, at least about 65%, at least about 70%, at least about 75%, at least about 80%, at least about 85%, at least about 90%, at least about 95%, at least about 97%, at least about 98%, at least about 99%, or 100%. In some examples, the percent complementarity between the targeting sequence and the target nucleic acid is at most about 30%, at most about 40%, at most about 50%, at most about 60%, at most about 65%, at most about 70%, at most about 75%, at most about 80%, at most about 85%, at most about 90%, at most about 95%, at most about 97%, at most about 98%, at most about 99%, or 100%. In some examples, the percent complementarity between the targeting sequence and the target nucleic acid is 100% over the six contiguous 5'-most nucleotides of the target sequence of the complementary strand of the target nucleic acid. The percent complementarity between the targeting sequence and the target nucleic acid can be at least 60% over about 20 contiguous nucleotides. The length of the targeting sequence and the target nucleic acid can differ by 1 to 6 nucleotides, which may be thought of as a bulge or bulges.

The targeting sequence can be designed or chosen using computer programs known to persons of ordinary skill in the art. The computer program can use variables, such as predicted melting temperature, secondary structure formation, predicted annealing temperature, sequence identity, genomic context, chromatin accessibility, % GC, frequency of genomic occurrence (e.g., of sequences that are identical or are similar but vary in one or more spots as a result of mismatch, insertion or deletion), methylation status, presence of SNPs, and the like. Available computer programs can take as input NCBI gene IDs, official gene symbols, Ensembl Gene IDs, genomic coordinates, or DNA sequences, and create an output file containing sgRNAs targeting the appropriate genomic regions designated as input. The computer program may also provide a summary of statistics and scores indicating on- and off-target binding of the sgRNA for the target gene (Doench et al. Nat Biotechnol. 34:184-191 (2016)). The disclosure provides guide RNAs comprising a targeting sequence. In some embodiments, the guide RNA further comprises a guide RNA scaffold sequence. In some embodiments, the targeting sequence is complementary to the sequence of a target gene selected from the group consisting of HLA-A, HLA-B, HLA-C, B2M or an allele thereof. In some embodiments, the target gene is an HLA-A gene. In some embodiments, the target gene is an HLA-B gene. In some embodiments, the target gene is an HLA-C gene. In some embodiments the target gene is HLA-A, HLA-B, HLA-C, or a combination thereof. In some embodiments, targeting sequence comprises a sequence that shares about 90%, about 95%, about 96%, about 97%, about 98%, about 99% identity to or is identical to a sequence disclosed in Tables 11 and 14.

In some embodiments, the gNAs specifically target the sequence of an endogenous HLA-A locus. In some embodiments, the gNAs that specifically target the sequence of an HLA-A locus comprise a sequence that shares about 90%, about 95%, about 96%, about 97%, about 98%, or about 99% identity to a sequence selected from the sequences disclosed in Table 11. In some embodiments, the gNAs that specifically target the sequence of an HLA-A locus comprise a sequence selected from the sequences disclosed in Table 11.

In some embodiments, the gNAs specifically target a sequence of HLA-A*02 alleles. For example, the gRNAs specifically target, and hybridize to, a sequence shared by all HLA-A*02 alleles, but that is not shared by HLA-A*02 and HLA-A*03 alleles. In some embodiments, the gNAs specifically target a sequence of HLA-A*02:01 alleles. In some embodiments, the gNAs specifically target a sequence of HLA-A*02:01:01 alleles. In some embodiments, the gNAs specifically target a sequence of HLA-A*02:01:01:01 alleles. In some embodiments, the gNAs specifically target a sequence of HLA-A*02:01:01:01 alleles.

In some embodiments, the gNAs specifically target a coding DNA sequence of HLA-A*02.

In some embodiments, the gNAs specifically target a coding DNA sequence that is shared by more than 1000 HLA-A*02 alleles. In some embodiments, the gNAs that specifically target a coding DNA sequence in greater than 1000 HLA-A*02 alleles comprise a sequence that shares about 90%, about 95%, about 96%, about 97%, about 98%, about 99% identity or is identical to a sequence selected from the sequences set forth in Table 11.

The sequences in Tables 11-14 are presented as DNA sequences. The skilled artisan will understand that thymine (T) can be replaced with uracil (U) in any DNA sequence including those set forth in Tables 11-14, to arrive at the corresponding RNA sequence.

TABLE 11

Illustrative sequences targeting HLA-A and HLA-A alleles

| SEQ ID NO | Sequences |
|---|---|
| 774 | TGGACGACACGCAGTTCGTG |
| 775 | CAGATACCTGGAGAACGGGA |
| 776 | TCCCGTTCTCCAGGTATCTG |
| 777 | CCGCCGCGGTCCAAGAGCGC |
| 778 | CCTGCGCTCTTGGACCGCGG |
| 779 | GGACCTGCGCTCTTGGACCGC |
| 780 | AAGGAGACGCTGCAGCGCACGGG |
| 781 | GAAGGAGACGCTGCAGCGCACGG |
| 782 | GCGGGCGCCGTGGATAGAGCAGG |
| 783 | TGCTCTATCCACGGCGCCCGCGG |
| 784 | CGATGAAGCGGGGCTCCCCGCGG |
| 785 | CGTGTCCCGGCCCGGCCGCGGGG |
| 786 | CGGCTCCATCCTCTGGCTCGCGG |
| 787 | GATGTAATCCTTGCCGTCGTAGG |
| 788 | ACAGCGACGCCGCGAGCCAGAGG |
| 789 | GGATGGAGCCGCGGGCGCCGTGG |
| 790 | GGCGCCGTGGATAGAGCAGGAGG |
| 791 | GCGCCGTGGATAGAGCAGGAGGG |
| 792 | CGGCTACTACAACCAGAGCGAGG |
| 793 | CTGGTTGTAGTAGCCGCGCAGGG |
| 794 | TACTACAACCAGAGCGAGGCCGG |
| 795 | CTACCTGGAGGGCACGTGCGTGG |
| 796 | CACGCACGTGCCCTCCAGGTAGG |
| 797 | GCAGGGTCCCCAGGTCCACTCGG |
| 798 | GTGGACCTGGGGACCCTGCGCGG |
| 799 | TGGAGGGCACGTGCGTGGAGTGG |
| 800 | GTATGGCTGCGACGTGGGGTCGG |
| 801 | CTGAGCTGCCATGTCCGCCGCGG |
| 802 | GGATTACATCGCCCTGAAAGAGG |
| 803 | CAAGTGGGAGGCGGCCCATGTGG |
| 804 | GTGGGAGGCGGCCCATGTGGCGG |
| 805 | CAGTTGAGAGCCTACCTGGAGGG |
| 806 | GCAGTTGAGAGCCTACCTGGAGG |
| 807 | TACCACCAGTACGCCTACGACGG |
| 808 | TGCCGTCGTAGGCGTACTGGTGG |
| 809 | CCAGTACGCCTACGACGGCAAGG |
| 810 | GGATGTGAAGAAATACCTCATGG |
| 811 | ATTTCTTCACATCCGTGTCCCGG |
| 812 | AGGCGTACTGGTGGTACCCGCGG |

TABLE 11-continued

Illustrative sequences targeting HLA-A and HLA-A alleles

| SEQ ID NO | Sequences |
|---|---|
| 813 | CGTACTGGTGGTACCCGCGGAGG |
| 814 | GAGGATGTATGGCTGCGACGTGG |
| 815 | GGATGTATGGCTGCGACGTGGGG |
| 816 | CTCAGACCACCAAGCACAAGTGG |
| 817 | TCAGACCACCAAGCACAAGTGGG |
| 818 | CACCAAGCACAAGTGGGAGGCGG |
| 819 | GACCACCAAGCACAAGTGGGAGG |
| 820 | GAGCCCCGCTTCATCGCAGTGGG |
| 821 | GTAGCCCACTGCGATGAAGCGGG |
| 822 | TAGCCCACTGCGATGAAGCGGGG |
| 823 | CGTAGCCCACTGCGATGAAGCGG |
| 824 | CTTCATCGCAGTGGGCTACGTGG |
| 825 | GGAGCCCCGCTTCATCGCAGTGG |
| 826 | CGGGGAGACACGGAAAGTGAAGG |
| 827 | AGTATTGGGACGGGGAGACACGG |
| 828 | AGGGTCCGGAGTATTGGGACGGG |
| 829 | GAGGGTCCGGAGTATTGGGACGG |
| 830 | GGACCCTCCTGCTCTATCCACGG |
| 831 | GTGGATAGAGCAGGAGGGTCCGG |
| 832 | AGACTCACCGAGTGGACCTGGGG |
| 833 | CACTCGGTGAGTCTGTGAGTGGG |
| 834 | CAGACTCACCGAGTGGACCTGGG |
| 835 | CCACTCACAGACTCACCGAGTGG |
| 836 | CCACTCGGTGAGTCTGTGAGTGG |
| 837 | TCGGACTGGCGCTTCCTCCGCGG |
| 838 | GCAGCCATACATCCTCTGGACGG |
| 839 | TCTCAACTGCTCCGCCACATGGG |
| 840 | ACCCTCATGCTGCACATGGCAGG |
| 841 | ACCTGCCATGTGCAGCATGAGGG |
| 842 | CACCTGCCATGTGCAGCATGAGG |
| 843 | GGAGGACCAGACCCAGGACACGG |
| 844 | GGATGGGAGGACCAGACCCAGGG |
| 845 | GACCTGGCAGCGGGATGGGGAGG |
| 846 | AGATCACACTGACCTGGCAGCGG |
| 847 | GATCACACTGACCTGGCAGCGGG |
| 848 | AGGTCAGTGTGATCTCCGCAGGG |
| 849 | AAGCCCCTCACCCTGAGATGGGG |
| 850 | CTGCGGAGATCACACTGACCTGG |
| 851 | CAGCAATGATGCCCACGATGGGG |
| 852 | CCAGCAATGATGCCCACGATGGG |
| 853 | GCCAGCAATGATGCCCACGATGG |
| 854 | GGATGGAACCTTCCAGAAGTGGG |
| 855 | GGGATGGAACCTTCCAGAAGTGG |
| 856 | ATGCCCACGATGGGGATGGTGGG |
| 857 | CAGCCCACCATCCCCATCGTGGG |
| 858 | CCAGCCCACCATCCCCATCGTGG |
| 859 | GATGCCCACGATGGGGATGGTGG |
| 860 | CAGGGCCCAGCACCTCAGGGTGG |
| 861 | AATGATGCCCACGATGGGGATGG |
| 862 | GGCCCTGACCCAGACCTGGGCGG |
| 863 | GACCCAGGACACGGAGCTCGTGG |
| 864 | ACACGGAGCTCGTGGAGACCAGG |
| 865 | CGTGGAGACCAGGCCTGCAGGGG |
| 866 | TCGTGGAGACCAGGCCTGCAGGG |
| 867 | AGCTGTGATCACTGGAGCTGTGG |
| 868 | AAAAGGAGGGAGCTACTCTCAGG |
| 869 | ATGTGGAGGAGGAAGAGCTCAGG |
| 870 | GTGTCTCTCACAGCTTGTAAAGG |
| 871 | GAGAGACACATCAGAGCCCTGGG |
| 872 | CTCCGCAGGGTAGAAGCTCAGGG |
| 873 | GGCCCTGAGCTTCTACCCTGCGG |
| 874 | GCTCAGGGCCCAGCACCTCAGGG |
| 875 | TATCTCTGCTCCTGTCCAGAAGG |
| 876 | AGTAGCAGGACGAGGGTTCGGGG |
| 877 | CCCCGAGAGTAGCAGGACGAGGG |
| 878 | CCCTCGTCCTGCTACTCTCGGGG |
| 879 | CCTCGTCCTGCTACTCTCGGGGG |
| 880 | CTGTGGTCGCTGCTGTGATGTGG |
| 881 | TCGCTGCTGTGATGTGGAGGAGG |
| 882 | TGGTCGCTGCTGTGATGTGGAGG |
| 883 | CACAGCCGCCCACTTCTGGAAGG |
| 884 | CCAGAAGTGGGCGGCTGTGGTGG |
| 885 | TGGAACCTTCCAGAAGTGGGCGG |

TABLE 11-continued

Illustrative sequences targeting HLA-A and HLA-A alleles

| SEQ ID NO | Sequences |
|---|---|
| 886 | TCACAGCTCCAAAGAGAACCAGG |
| 887 | CTGACCATGAAGCCACCCTGAGG |
| 888 | GCAAACCCTCATGCTGCACATGG |
| 889 | TGAAGCCACCCTGAGGTGCTGGG |
| 890 | GGTGAGTCATATGCGTTTTGGGG |
| 891 | GTGAGTCATATGCGTTTTGGGGG |
| 892 | CTTCATGGTCAGAGACAGCGTGG |
| 893 | TCTGGCCCTGACCCAGACCTGGG |

The sequences disclosed in Table 11 include the corresponding genomic sequences, inclusive of the PAM sequence. The skilled artisan will understand that the targeting sequence of the gRNA does not include three 3' terminal nucleotides of the sequences in Table 11, which represent the corresponding PAM site for the gRNA.

The disclosure provides gNAs comprising a targeting sequence specific to the B2M gene. In some embodiments, the gNAs specifically target the coding sequence (CDS) sequence of the B2M gene. In some embodiments, the gNA comprises a sequence that targets the B2M gene promoter sequence.

In some embodiments the gNA comprise a targeting sequence and a gNA scaffold sequence. In some embodiments, the targeting sequence comprises a sequence set forth in Table 12, or a sequence shares about 90%, about 95%, about 96%, about 97%, about 98%, about 99% identity thereto.

In some embodiments, the targeting sequence is complementary to a sequence of the B2M gene. In some embodiments, the B2M gene comprises a sequence that shares about 90%, about 95%, about 96%, about 97%, about 98%, about 99% identity to the B2M sequence set forth in Table 10.

TABLE 12

Illustrative sequences targeting B2M

| SEQ ID NO | Sequence |
|---|---|
| 894 | CGCGAGCACAGCTAAGGCCA |
| 895 | GAGTAGCGCGAGCACAGCTA |
| 896 | AGGGTAGGAGAGACTCACGC |
| 897 | CTGAATCTTTGGAGTACCTG |
| 898 | TCACGTCATCCAGCAGAGAA |
| 899 | TCCTGAATTGCTATGTGTCT |
| 900 | AAGTCAACTTCAATGTCGGA |
| 901 | GTCTTTTCCCGATATTCCTC |
| 902 | TGGAGTACCTGAGGAATATC |
| 903 | CAGCCCAAGATAGTTAAGTG |
| 904 | ACAAAGTCACATGGTTCACA |
| 905 | ACTCTCTCTTTCTGGCCTGG |
| 906 | TGGGCTGTGACAAAGTCACA |
| 907 | GGCCGAGATGTCTCGCTCCG |
| 908 | CAGTAAGTCAACTTCAATGT |
| 909 | ACTCACGCTGGATAGCCTCC |
| 910 | CATACTCATCTTTTTCAGTG |
| 911 | CACAGCCCAAGATAGTTAAG |
| 912 | TTCAGACTTGTCTTTCAGCA |
| 913 | AGTCACATGGTTCACACGGC |
| 914 | ATACTCATCTTTTTCAGTGG |
| 915 | GGCATACTCATCTTTTTCAG |
| 916 | ACAGCCCAAGATAGTTAAGT |
| 917 | GCTACTCTCTCTTTCTGGCC |
| 918 | TGGAGAGAGAATTGAAAAAG |
| 919 | ACTTGTCTTTCAGCAAGGAC |
| 920 | GAAGTTGACTTACTGAAGAA |
| 921 | GGCCACGGAGCGAGACATCT |
| 922 | GCATACTCATCTTTTTCAGT |
| 923 | CGTGAGTAAACCTGAATCTT |
| 924 | TTACCCCACTTAACTATCTT |
| 925 | TTGGAGTACCTGAGGAATAT |
| 926 | ACCCAGACACATAGCAATTC |
| 927 | TTTGACTTTCCATTCTCTGC |
| 928 | TTCCTGAATTGCTATGTGTC |
| 929 | CTCAGGTACTCCAAAGATTC |
| 930 | CTTACCCCACTTAACTATCT |
| 931 | CTCGCGCTACTCTCTCTTTC |
| 932 | TCGATCTATGAAAAAGACAG |
| 933 | GAGACATGTAAGCAGCATCA |
| 934 | ACATGTAAGCAGCATCATGG |
| 935 | GAAGTCCTAGAATGAGCGCC |
| 936 | GAGCGCCCGGTGTCCCAAGC |
| 937 | AGCGCCCGGTGTCCCAAGCT |
| 938 | GCGCCCGGTGTCCCAAGCTG |
| 939 | CTGGGGCGCGCACCCCAGAT |
| 940 | GGGCGCGCACCCCAGATCGG |

TABLE 12-continued

Illustrative sequences targeting B2M

| SEQ ID NO | Sequence |
|---|---|
| 941 | GGCGCGCACCCCAGATCGGA |
| 942 | CATCACGAGACTCTAAGAAA |
| 943 | TAAGAAAAGGAAACTGAAAA |
| 944 | AAGAAAAGGAAACTGAAAAC |
| 945 | GAAAGTCCCTCTCTCTAACC |
| 946 | CTAACCTGGCACTGCGTCGC |
| 947 | CTGGCACTGCGTCGCTGGCT |
| 948 | TGCGTCGCTGGCTTGGAGAC |
| 949 | GCTGGCTTGGAGACAGGTGA |
| 950 | GAGACAGGTGACGGTCCCTG |
| 951 | AGACAGGTGACGGTCCCTGC |
| 952 | CCTGCGGGCCTTGTCCTGAT |
| 953 | CGGGCCTTGTCCTGATTGGC |
| 954 | GGGCCTTGTCCTGATTGGCT |
| 955 | GGGCACGCGTTTAATATAAG |
| 956 | CACGCGTTTAATATAAGTGG |
| 957 | TATAAGTGGAGGCGTCGCGC |
| 958 | AAGTGGAGGCGTCGCGCTGG |
| 959 | AGTGGAGGCGTCGCGCTGGC |
| 960 | TTCCTGAAGCTGACAGCATT |
| 961 | TCCTGAAGCTGACAGCATTC |
| 962 | GCCCGAATGCTGTCAGCTTC |
| 963 | AAACGCGTGCCCAGCCAATC |
| 964 | GTGCCCAGCCAATCAGGACA |
| 965 | CCAATCAGGACAAGGCCCGC |
| 966 | CAATCAGGACAAGGCCCGCA |
| 967 | CAAGCCAGCGACGCAGTGCC |
| 968 | CGCAGTGCCAGGTTAGAGAG |
| 969 | GCAGTGCCAGGTTAGAGAGA |
| 970 | GAGTCTCGTGATGTTTAAGA |
| 971 | TAAGAAGGCATGCACTAGAC |
| 972 | AAGAAGGCATGCACTAGACT |
| 973 | TGAGTTTGCTGTCTGTACAT |
| 974 | TACATCGGCGCCCTCCGATC |
| 975 | ACATCGGCGCCCTCCGATCT |
| 976 | CATCGGCGCCCTCCGATCTG |
| 977 | CTGGGGTGCGCGCCCCAGCT |
| 978 | TGGGGTGCGCGCCCCAGCTT |
| 979 | CGCGCCCCAGCTTGGGACAC |
| 980 | GCGCCCCAGCTTGGGACACC |
| 981 | CAAGTCACTTAGCATCTCTG |
| 982 | ACAGAAGTTCTCCTTCTGCT |
| 983 | ATTCAAAGATCTTAATCTTC |
| 984 | TTCAAAGATCTTAATCTTCT |
| 985 | TTTTCTCGAATGAAAAATGC |
| 986 | TGCAGGTCCGAGCAGTTAAC |
| 987 | GGTCCGAGCAGTTAACTGGC |
| 988 | GTCCGAGCAGTTAACTGGCT |
| 989 | TCCGAGCAGTTAACTGGCTG |
| 990 | AGCAAGTCACTTAGCATCTC |
| 991 | GCAAGTCACTTAGCATCTCT |
| 992 | TGGGGCCAGTCTGCAAAGCG |
| 993 | GGGGCCAGTCTGCAAAGCGA |
| 994 | GGGCCAGTCTGCAAAGCGAG |
| 995 | GGCCAGTCTGCAAAGCGAGG |
| 996 | GGACACCGGGCGCTCATTCT |
| 997 | GGCGCTCATTCTAGGACTTC |
| 998 | CTCATTCTAGGACTTCAGGC |
| 999 | ATTCTAGGACTTCAGGCTGG |
| 1000 | TTCAGGCTGGAGGCACATTA |
| 1001 | TGCCCCCTCGCTTTGCAGAC |
| 1002 | GATGCTAAGTGACTTGCTAA |
| 1003 | GCCCCAGCCAGTTAACTGCT |
| 1004 | GCATTTTCATTCGAGAAAA |
| 1005 | TTTGAATGCTACCTAGCAGA |
| 1006 | TTCTGTTTATAACTACAGCT |
| 1007 | TCTGTTTATAACTACAGCTT |

In some embodiments, the immune cells described herein are edited using TALEN gene editing.

"TALEN" or "TALEN gene editing" refers to a transcription activator-like effector nuclease, which is an artificial nuclease used to edit a target gene.

TALENs are produced artificially by fusing a TAL effector DNA binding domain to a DNA cleavage domain. Transcription activator-like effectors (TALEs) derived from *Xanthomonas* bacteria can be engineered to bind any desired DNA sequence, including a portion of target genes such as TCR subunits, MHC class I complex components, or CD52. By combining an engineered TALE with a DNA cleavage domain, a restriction enzyme can be produced which is specific to any desired DNA sequence, including a target gene sequence. These can then be introduced into a cell, wherein they can be used for genome editing.

To produce a TALEN, a TALE protein is fused to a nuclease (N), which is a wild-type or mutated FokI endonuclease. Several mutations to FokI have been made for its use in TALENs; these, for example, improve cleavage specificity or activity.

The FokI domain functions as a dimer, requiring two constructs with unique DNA binding domains for sites in the target genome with proper orientation and spacing. Both the number of amino acid residues between the TALE DNA binding domain and the FokI cleavage domain and the number of bases between the two individual TALEN binding sites appear to be important parameters for achieving high levels of activity.

TALENs specific to sequences in a target gene can be constructed using any method known in the art, including various schemes using modular components.

In some embodiments, a target gene is edited in the immune cells described herein using ZFN gene editing.

"ZFN" or "Zinc Finger Nuclease" or "ZFN gene editing" refer to a zinc finger nuclease, an artificial nuclease which can be used to edit a target gene.

Like a TALEN, a ZFN comprises a FokI nuclease domain (or derivative thereof) fused to a DNA-binding domain. In the case of a ZFN, the DNA-binding domain comprises one or more zinc fingers.

A zinc finger is a small protein structural motif stabilized by one or more zinc ions. A zinc finger can comprise, for example, Cys2His2, and can recognize an approximately 3-bp sequence. Various zinc fingers of known specificity can be combined to produce multi-finger polypeptides which recognize about 6, 9, 12, 15 or 18-bp sequences. Various selection and modular assembly techniques are available to generate zinc fingers (and combinations thereof) recognizing specific sequences, including phage display, yeast one-hybrid systems, bacterial one-hybrid and two-hybrid systems, and mammalian cells.

Like a TALEN, a ZFN must dimerize to cleave DNA. Thus, a pair of ZFNs are required to target non-palindromic DNA sites. The two individual ZFNs must bind opposite strands of the DNA with their nucleases properly spaced apart.

Also like a TALEN, a ZFN can create a double-stranded break in the DNA, which can create a frame-shift mutation if improperly repaired, leading to a decrease in the expression and amount of a target gene or gene product in a cell. ZFNs can also be used with homologous recombination to mutate in a target gene.

ZFNs specific to sequences in a target gene can be constructed using any method known in the art.

In some embodiments, the expression and of function of one or more MCH-I components are reduced using RNA interference. "RNAi" or "RNA interference" refers to the process of sequence-specific post-transcriptional gene silencing, mediated by double-stranded RNA (dsRNA). Duplex RNAs such as siRNA (small interfering RNA), miRNA (micro RNA), shRNA (short hairpin RNA), ddRNA (DNA-directed RNA), piRNA (Piwi-interacting RNA), or rasiRNA (repeat associated siRNA) and modified forms thereof are all capable of mediating RNA interference. These dsRNA molecules may be commercially available or may be designed and prepared based on known sequence information. The anti-sense strand of these molecules can include RNA, DNA, PNA, or a combination thereof. DNA/RNA chimeric polynucleotides include, but are not limited to, a double-strand polynucleotide composed of DNA and RNA that inhibits the expression of a target gene. dsRNA molecules can also include one or more modified nucleotides, as described herein, which can be incorporated on either or both strands.

In RNAi gene silencing or knockdown, dsRNA comprising a first (anti-sense) strand that is complementary to a portion of a target gene and a second (sense) strand that is fully or partially complementary to the first anti-sense strand is introduced into an organism. After introduction into the organism, the target gene-specific dsRNA is processed into relatively small fragments (siRNAs) and can subsequently become distributed throughout the organism, decrease messenger RNA of target gene, leading to a phenotype that may come to closely resemble the phenotype arising from a complete or partial deletion of the target gene.

Certain dsRNAs in cells can undergo the action of Dicer enzyme, a ribonuclease III enzyme. Dicer can process the dsRNA into shorter pieces of dsRNA, i.e. siRNAs. RNAi also involves an endonuclease complex known as the RNA induced silencing complex (RISC). Following cleavage by Dicer, siRNAs enter the RISC complex and direct cleavage of a single stranded RNA target having a sequence complementary to the anti-sense strand of the siRNA duplex. The other strand of the siRNA is the passenger strand. Cleavage of the target RNA takes place in the middle of the region complementary to the anti-sense strand of the siRNA duplex. siRNAs can thus down regulate or knock down gene expression by mediating RNA interference in a sequence-specific manner.

As used herein with respect to RNA interference, "target gene" or "target sequence" refers to a gene or gene sequence whose corresponding RNA is targeted for degradation through the RNAi pathway using dsRNAs or siRNAs as described herein. Exemplary target gene sequences are shown in Table 10. To target a gene, for example using an siRNA, the siRNA comprises an anti-sense region complementary to, or substantially complementary to, at least a portion of the target gene or sequence, and sense strand complementary to the anti-sense strand. Once introduced into a cell, the siRNA directs the RISC complex to cleave an RNA comprising a target sequence, thereby degrading the RNA. The disclosure provides interfering RNAs. The double stranded RNA molecule of the disclosure may be in the form of any type of RNA interference molecule known in the art. In some embodiments, the double stranded RNA molecule is a small interfering RNA (siRNA). In other embodiments, the double stranded RNA molecule is a short hairpin RNA (shRNA) molecule. In other embodiments, the double stranded RNA molecule is a Dicer substrate that is processed in a cell to produce an siRNA. In other embodiments the double stranded RNA molecule is part of a microRNA precursor molecule.

In some embodiments, the shRNA is a length to be suitable as a Dicer substrate, which can be processed to produce a RISC active siRNA molecule. See, e.g., Rossi et al., US2005/0244858.

A Dicer substrate double stranded RNA (e.g. a shRNA) can be of a length sufficient that it is processed by Dicer to produce an active siRNA, and may further include one or more of the following properties: (i) the Dicer substrate shRNA can be asymmetric, for example, having a 3' overhang on the anti-sense strand, (ii) the Dicer substrate shRNA can have a modified 3' end on the sense strand to direct orientation of Dicer binding and processing of the dsRNA to an active siRNA, for example the incorporation of one or more DNA nucleotides, and (iii) the first and second strands of the Dicer substrate ds RNA can be from 21-30 bp in length.

In some embodiments, the interfering RNAs comprise a sequence complementary to a sequence of a B2M mRNA. In some embodiments, the interfering RNA is capable of inducing RNAi-mediated degradation of the B2M mRNA. In some embodiments, the B2M mRNA sequence comprises a coding sequence. In some embodiments, the B2M mRNA sequence comprises an untranslated region.

In some embodiments, the interfering RNAs comprise a sequence complementary to a sequence of an HLA-A*02 mRNA. In some embodiments, the interfering RNA is capable of inducing RNAi-mediated degradation of the HLA-A*02 mRNA. In some embodiments, the HLA-A*02 mRNA sequence comprises a coding sequence. In some embodiments, the HLA-A*02 mRNA sequence comprises an untranslated region.

In some embodiments, the interfering RNA is a short hairpin RNA (shRNA). In some embodiments, the shRNA comprises a first sequence, having from 5' to 3' end a sequence complementary to the B2M mRNA; and a second sequence, having from 5' to 3' end a sequence complementary to the first sequence, wherein the first sequence and second sequence form the shRNA.

In some embodiments, the first sequence is 18, 19, 20, 21, or 22 nucleotides. In some embodiments, the first sequence is complementary to a sequence selected from the sequences set forth in Tables 13 and 14. In some embodiments, the first sequence has GC content greater than or equal to 25% and less than 60%. In some embodiments, the first sequence is complementary to a sequence selected from the sequences set forth in Tables 13 and 14. In some embodiments, the first sequence does not comprise four nucleotides of the same base or a run of seven C or G nucleotide bases. In some embodiments, the first sequence is 21 nucleotides.

Illustrative target B2M sequences complementary to the first sequence are shown in Table 13.

In some cases, the first sequence may have 100% identity, i.e. complete identity, homology, complementarity to the target nucleic acid sequence. In other cases, there may be one or more mismatches between the first sequence and the target nucleic acid sequence. For example, there may be 1, 2, 3, 4, 5, 6, or 7 mismatches between the sense region and the target nucleic acid sequence.

The sequences set forth in Table 13 are presented as DNA sequences. In all sequences set forth in Table 13, thymine (T) may be replaced by uracil (U) to arrive at the sequence of the target mRNA sequence.

TABLE 13

Illustrative target B2M sequences complementary to first sequence

| SEQ ID NO | Sequence |
|---|---|
| 1008 | AGAGAATGGAAAGTCAAATTT |
| 1009 | ATGGACATGATCTTCTTTATA |
| 1010 | TGGACATGATCTTCTTTATAA |
| 1011 | GGACATGATCTTCTTTATAAT |
| 1012 | TGACAGGATTATTGGAAATTT |
| 1013 | TTGTGGTTAATCTGGTTTATT |

TABLE 13-continued

Illustrative target B2M sequences complementary to first sequence

| SEQ ID NO | Sequence |
|---|---|
| 1014 | TGTGGTTAATCTGGTTTATTT |
| 1015 | GCAGAGAATGGAAAGTCAAAT |
| 1016 | CAGAGAATGGAAAGTCAAATT |
| 1017 | GAGAATGGAAAGTCAAATTTC |
| 1018 | GTCACAGCCCAAGATAGTTAA |
| 1019 | TGCTTATACACTTACACTTTA |
| 1020 | GCTTATACACTTACACTTTAT |
| 1021 | CTTATACACTTACACTTTATG |
| 1022 | ACATGGACATGATCTTCTTTA |
| 1023 | CATGGACATGATCTTCTTTAT |
| 1024 | ATCAACATCTTGGTCAGATTT |
| 1025 | CTTGCACTCAAAGCTTGTTAA |
| 1026 | AGTTAAGCGTGCATAAGTTAA |
| 1027 | GCATAAGTTAACTTCCAATTT |
| 1028 | TACATACTCTGCTTAGAATTT |
| 1029 | ACATACTCTGCTTAGAATTTG |
| 1030 | TTGACAGGATTATTGGAAATT |
| 1031 | GACAGGATTATTGGAAATTTG |
| 1032 | TAAGGCATGGTTGTGGTTAAT |
| 1033 | GTTGTGGTTAATCTGGTTTAT |
| 1034 | GTTCCACAAGTTAAATAAATC |
| 1035 | TCCAGCGTACTCCAAAGATTC |
| 1036 | TACTCCAAAGATTCAGGTTTA |
| 1037 | ACTCCAAAGATTCAGGTTTAC |
| 1038 | CACGTCATCCAGCAGAGAATG |
| 1039 | GGTTTCATCCATCCGACATTG |
| 1040 | CCGACATTGAAGTTGACTTAC |
| 1041 | TGAAGAATGGAGAGAGAATTG |
| 1042 | GAGCATTCAGACTTGTCTTTC |
| 1043 | TTCAGCAAGGACTGGTCTTTC |
| 1044 | GCAAGGACTGGTCTTTCTATC |
| 1045 | CGTGTGAACCATGTGACTTTG |
| 1046 | CTTTGTCACAGCCCAAGATAG |
| 1047 | TCACAGCCCAAGATAGTTAAG |
| 1048 | AGTGGGATCGAGACATGTAAG |
| 1049 | AGGTTTGAAGATGCCGCATTT |
| 1050 | GGTTTGAAGATGCCGCATTTG |

TABLE 13-continued

Illustrative target B2M sequences complementary to first sequence

| SEQ ID NO | Sequence |
|---|---|
| 1051 | TTGATATGCTTATACACTTAC |
| 1052 | TGAGTGCTGTCTCCATGTTTG |
| 1053 | TGTCTCCATGTTTGATGTATC |
| 1054 | TCAACATCTTGGTCAGATTTG |
| 1055 | TCAGATTTGAACTCTTCAATC |
| 1056 | TTCAATCTCTTGCACTCAAAG |
| 1057 | TTGCACTCAAAGCTTGTTAAG |
| 1058 | ACTCAAAGCTTGTTAAGATAG |
| 1059 | AGATAGTTAAGCGTGCATAAG |
| 1060 | TGCATAAGTTAACTTCCAATT |
| 1061 | GTTAACTTCCAATTTACATAC |
| 1062 | ATTGACAGGATTATTGGAAAT |
| 1063 | GTAAGGCATGGTTGTGGTTAA |
| 1064 | GGTTGTGGTTAATCTGGTTTA |
| 1065 | TTCCTGAAGCTGACAGCATTC |
| 1066 | GCTATCCAGCGTACTCCAAAG |
| 1067 | CATCCAGCAGAGAATGGAAAG |
| 1068 | CAAATTTCCTGAATTGCTATG |
| 1069 | ATTGCTATGTGTCTGGGTTTC |
| 1070 | GAAGATGCCGCATTTGGATTG |
| 1071 | CAATTTACATACTCTGCTTAG |
| 1072 | TATCCAGCGTACTCCAAAGAT |
| 1073 | ATCCAGCGTACTCCAAAGATT |
| 1074 | CTCCAAAGATTCAGGTTTACT |
| 1075 | TGCTATGTGTCTGGGTTTCAT |
| 1076 | TTTCATCCATCCGACATTGAA |
| 1077 | GAAGTTGACTTACTGAAGAAT |
| 1078 | GAAGAATGGAGAGAGAATTGA |
| 1079 | AGAATGGAGAGAGAATTGAAA |
| 1080 | CAGCAAGGACTGGTCTTTCTA |
| 1081 | AGCAAGGACTGGTCTTTCTAT |
| 1082 | ACTTTGTCACAGCCCAAGATA |
| 1083 | TTGTCACAGCCCAAGATAGTT |
| 1084 | TGTCACAGCCCAAGATAGTTA |
| 1085 | CACAGCCCAAGATAGTTAAGT |
| 1086 | GCAGCATCATGGAGGTTTGAA |
| 1087 | CCGCATTTGGATTGGATGAAT |
| 1088 | TTGAGTGCTGTCTCCATGTTT |
| 1089 | AGTGCTGTCTCCATGTTTGAT |
| 1090 | CTGTCTCCATGTTTGATGTAT |
| 1091 | TCTAGGAGGGCTGGCAACTTA |
| 1092 | CAACATCTTGGTCAGATTTGA |
| 1093 | GTCAGATTTGAACTCTTCAAT |
| 1094 | TCTTGCACTCAAAGCTTGTTA |
| 1095 | TGCACTCAAAGCTTGTTAAGA |
| 1096 | GCACTCAAAGCTTGTTAAGAT |
| 1097 | CACTCAAAGCTTGTTAAGATA |
| 1098 | TCAAAGCTTGTTAAGATAGTT |
| 1099 | CAAAGCTTGTTAAGATAGTTA |
| 1100 | GATAGTTAAGCGTGCATAAGT |
| 1101 | ATAGTTAAGCGTGCATAAGTT |
| 1102 | TAGTTAAGCGTGCATAAGTTA |
| 1103 | TTAAGCGTGCATAAGTTAACT |
| 1104 | TAAGCGTGCATAAGTTAACTT |
| 1105 | ATTTACATACTCTGCTTAGAA |
| 1106 | TTTACATACTCTGCTTAGAAT |
| 1107 | ACAGGATTATTGGAAATTTGT |
| 1108 | CAGGATTATTGGAAATTTGTT |
| 1109 | AGGCATGGTTGTGGTTAATCT |
| 1110 | CAGCAGAGAATGGAAAGTCAA |
| 1111 | TCCGACATTGAAGTTGACTTA |
| 1112 | CTGGTCTTTCTATCTCTTGTA |
| 1113 | CCGTGTGAACCATGTGACTTT |
| 1114 | CCCAAGATAGTTAAGTGGGAT |
| 1115 | GGTTGCTCCACAGGTAGCTCT |
| 1116 | GCTCCACAGGTAGCTCTAGGA |
| 1117 | GGGAGCAGAGAATTCTCTTAT |
| 1118 | GGAGCAGAGAATTCTCTTATC |
| 1119 | GAGCAGAGAATTCTCTTATCC |
| 1120 | GAGAATTCTCTTATCCAACAT |
| 1121 | GAATTCTCTTATCCAACATCA |
| 1122 | AAGTGGAGCATTCAGACTTGT |
| 1123 | AAGGACTGGTCTTTCTATCTC |
| 1124 | AAGCTTGTTAAGATAGTTAAG |

TABLE 13-continued

Illustrative target B2M sequences complementary to first sequence

| SEQ ID NO | Sequence |
|---|---|
| 1125 | AAGCGTGCATAAGTTAACTTC |
| 1126 | AAGATGCCGCATTTGGATTGG |
| 1127 | AAGAATGGAGAGAGAATTGAA |
| 1128 | AACATCAACATCTTGGTCAGA |
| 1129 | AAGGCATGGTTGTGGTTAATC |
| 1130 | AAGCAGCATCATGGAGGTTTG |
| 1131 | AAGATGAGTATGCCTGCCGTG |
| 1132 | AAGTTGACTTACTGAAGAATG |
| 1133 | AAGATAGTTAAGCGTGCATAA |
| 1134 | AACTTCCAATTTACATACTCT |
| 1135 | AACATCTTGGTCAGATTTGAA |
| 1136 | AACTCTTCAATCTCTTGCACT |
| 1137 | AATTTCCTGAATTGCTATGTG |
| 1138 | AATGGAAAGTCAAATTTCCTG |
| 1139 | AACCATGTGACTTTGTCACAG |
| 1140 | AATTGACAGGATTATTGGAAA |
| 1141 | AATTCTCTTATCCAACATCAA |
| 1142 | AAAGTGGAGCATTCAGACTTG |
| 1143 | AAAGTCAAATTTCCTGAATTG |
| 1144 | GTTGCTCCACAGGTAGCTCTA |
| 1145 | AATTTACATACTCTGCTTAGA |

An exemplary sequence encoding a B2M shRNA comprises a sequence of GCACTCAAAGCTTGTTAA-GATCGAAATCTTAACAAGCTTTGAGTGC (SEQ ID NO: 349), or a sequence having at least 90%, at least 95%, at least 97% or at least 99% identity thereto. A further exemplary sequence encoding a B2M shRNA comprises a sequence of GTTAACTTCCAATTTACAT-ACCGAAGTATGTAAATTGGAAGTTAAC (SEQ ID NO: 350), or a sequence having at least 90%, at least 95%, at least 97% or at least 99% identity thereto.

In some embodiments, the interfering RNAs comprise a sequence complementary to a sequence of an HLA-A*02 mRNA. In some embodiments, the interfering RNA is capable of inducing RNAi-mediated degradation of the HLA-A*02 mRNA. In some embodiments, the HLA-A*02 mRNA sequence comprises a coding sequence. In some embodiments, the HLA-A*02 mRNA sequence comprises an untranslated region.

In some embodiments, the interfering RNA is a short hairpin RNA (shRNA). In some embodiments, the shRNA comprises a first sequence, having from 5' to 3' end a sequence complementary to the HLA-A*02 mRNA; and a second sequence, having from 5' to 3' end a sequence complementary to the first sequence, wherein the first sequence and second sequence form the shRNA Illustrative target HLA sequences complementary to the first sequence are shown in Table 14.

TABLE 14

Illustrative target HLA sequences complementary to first sequence

| SEQ ID NO | Sequence |
|---|---|
| 1146 | CTTCTTCCTTCCCTATTAAAA |
| 1147 | TCTCACTCCATGAGGTATTTC |
| 1148 | CTCTCACTCCATGAGGTATTT |
| 1149 | GAGGAGGAAGAGCTCAGATAG |
| 1150 | GCTCTCACTCCATGAGGTATT |
| 1151 | AGGATTACATCGCCCTGAAAG |
| 1152 | ACACCGTCCAGAGGATGTATG |
| 1153 | AGGGTCCTTCTTCCTGGATAC |
| 1154 | CCTACGACGGCAAGGATTACA |
| 1155 | TCACTCCATGAGGTATTTCTT |
| 1156 | CTACGACGGCAAGGATTACAT |
| 1157 | CTCACTCCATGAGGTATTTCT |
| 1158 | GGAGGAAGAGCTCAGATAGAA |
| 1159 | CACACCGTCCAGAGGATGTAT |
| 1160 | CACGCTGTCTCTGACCATGAA |
| 1161 | CTGGACAGGAGCAGAGATACA |
| 1162 | TGGAGGAGGAAGAGCTCAGAT |
| 1163 | GGCTCTCACTCCATGAGGTAT |
| 1164 | CATCTCTGTCTCAACTTCATG |
| 1165 | TACGACGGCAAGGATTACATC |
| 1166 | GGATTACATCGCCCTGAAAGA |
| 1167 | GATTACATCGCCCTGAAAGAG |
| 1168 | CTCAGACCACCAAGCACAAGT |
| 1169 | TCACACCGTCCAGAGGATGTA |
| 1170 | ACTCCATGAGGTATTTCTTCA |
| 1171 | CACTCCATGAGGTATTTCTTC |
| 1172 | CCATGAGGTATTTCTTCACAT |
| 1173 | ACTTCTTCCTTCCCTATTAAA |
| 1174 | GTGTCTCTCACAGCTTGTAAA |
| 1175 | CTGTGTTCGTGTAGGCATAAT |
| 1176 | TGTGTTCGTGTAGGCATAATG |
| 1177 | TAACTTCTTCCTTCCCTATTA |
| 1178 | TCTGGACAGGAGCAGAGATAC |
| 1179 | TTGCTGGCCTGGTTCTCTTTG |
| 1180 | TGTCTCTCACAGCTTGTAAAG |

TABLE 14-continued

Illustrative target HLA sequences complementary to first sequence

| SEQ ID NO | Sequence |
|---|---|
| 1181 | ACTTGAAGAACCCTGACTTTG |
| 1182 | GAAGAACCCTGACTTTGTTTC |
| 1183 | TCTGTGTTCGTGTAGGCATAA |
| 1184 | CATGGTGCACTGAGCTGTAAC |
| 1185 | GTAACTTCTTCCTTCCCTATT |
| 1186 | CATGTGCAGCATGAGGGTTTG |
| 1187 | TTGTTCCTGCCCTTCCCTTTG |
| 1188 | ACCCAGTTCTCACTCCCATTG |
| 1189 | GGGTTTCCAGAGAAGCCAATC |
| 1190 | TTCTCCCTCTCCCAACCTATG |
| 1191 | GTCTCTCACAGCTTGTAAAGT |
| 1192 | TGTGTCTCTCACAGCTTGTAA |
| 1193 | GAGGAAGAGCTCAGATAGAAA |
| 1194 | TGAAGAACCCTGACTTTGTTT |
| 1195 | TTGAAGAACCCTGACTTTGTT |
| 1196 | GTGTTCGTGTAGGCATAATGT |
| 1197 | TGGTGCACTGAGCTGTAACTT |
| 1198 | CTCCCTCTCCCAACCTATGTA |
| 1199 | AGGAGGAAGAGCTCAGATAGA |
| 1200 | ACCTATGTAGGGTCCTTCTTC |
| 1201 | GGGTCCTTCTTCCTGGATACT |
| 1202 | GGTCCTTCTTCCTGGATACTC |
| 1203 | GTCCTTCTTCCTGGATACTCA |
| 1204 | AAGCCAATCAGTGTCGTCGCG |
| 1205 | AAGAGGACCTGCGCTCTTGGA |
| 1206 | AAGTGTGAGACAGCTGCCTTG |
| 1207 | AAGGCACCTGCATGTGTCTGT |
| 1208 | AATCATCTTTCCTGTTCCAGA |
| 1209 | AAAGGCACCTGCATGTGTCTG |
| 1210 | AAAGAGGACCTGCGCTCTTGG |
| 1211 | AAACGCATATGACTCACCACG |
| 1212 | GGAAGAGCTCAGATAGAAA |
| 1213 | GGGAGACACGGAAAGTGAA |
| 1214 | CACCTGCCATGTGCAGCATGA |
| 1215 | GGAGATCACACTGACCTGGCA |
| 1216 | GGATTACATCGCCCTGAAAG |
| 1217 | GCAGGAGGGTCCGGAGTATT |
| 1218 | GGACGGGGAGACACGGAAAG |
| 1219 | GAAAGTGAAGGCCCACTCA |
| 1220 | GATACCTGGAGAACGGGAAG |
| 1221 | GCTGTGGTGGTGCCTTCTGG |
| 1222 | GCTACTACAACCAGAGCGAG |
| 1223 | GTGGCTCCGCAGATACCTG |
| 1224 | GCCAATCAGTGTCGTCGCG |
| 1225 | GAGGACCTGCGCTCTTGGA |
| 1226 | GTGTGAGACAGCTGCCTTG |
| 1227 | GGCACCTGCATGTGTCTGT |
| 1228 | TCATCTTTCCTGTTCCAGA |
| 1229 | AGGCACCTGCATGTGTCTG |
| 1230 | AGAGGACCTGCGCTCTTGG |
| 1231 | ACGCATATGACTCACCACG |

In some embodiments, the first sequence and second sequence are separated by a linker, sometimes referred to as a loop. In some embodiments, both the first sequence and the second sequence are encoded by one single-stranded RNA or DNA vector. In some embodiments, the loop is between the first and second sequences. In these embodiments, and the first sequence and the second sequence hybridize to form a duplex region. The first sequence and second sequence are joined by a linker sequence, forming a "hairpin" or "stem-loop" structure. The shRNA can have complementary first sequences and second sequences at opposing ends of a single stranded molecule, so that the molecule can form a duplex region with the complementary sequence portions, and the strands are linked at one end of the duplex region by a linker (i.e. loop sequence). The linker, or loop sequence, can be either a nucleotide or non-nucleotide linker. The linker can interact with the first sequence, and optionally, second sequence through covalent bonds or non-covalent interactions.

Any suitable nucleotide loop sequence is envisaged as within the scope of the disclosure. An shRNA of this disclosure may include a nucleotide, non-nucleotide, or mixed nucleotide/non-nucleotide linker that joins the first sequence of the shRNA to the second sequence of the shRNA. A nucleotide loop sequence can be >2 nucleotides in length, for example about 4, 5, 6, 7, 8, 9, 10, 11, 12, 13, 14, or 15 nucleotides in length. Illustrative loop sequences are disclosed in Table 16.

In some embodiments, the shRNA further comprises a 5' flank sequence and a 3' flank sequence. In some embodiments, wherein the 5' flank sequence is joined to the 5' end of the first sequence, and wherein the 3' flank sequence is joined to the 3' end of the second sequence.

Without wishing to be bound by theory, it is thought that flanking shRNA stem loop sequence with 5' and 3' sequences similar to those found in microRNAs can target the shRNA for processing by the endogenous microRNA processing machinery, increasing the effectiveness of shRNA processing. Alternatively, or in addition, flanking sequences may increase shRNA compatibility with polymerase II or polymerase III promoters, leading to more effective regulation of shRNA expression.

In some embodiments, the 5' flank sequence is selected from the sequences set forth in Table 15. Illustrative flank sequence are shown in Table 15.

TABLE 15

Illustrative flank sequences

| SEQ ID NO | 5' Flank Sequence |
|---|---|
| 1232 | GG |
| 1233 | ACACCAUGUUGCCAGUCUCUAGG |
| 1234 | UGAUAGCAAUGUCAGCAGUGCCU |
| 1235 | UAUUGCUGUUGACAGUGAGCGAC |

| SEQ ID NO | 3' Flank Sequence |
|---|---|
| 1236 | UGGCGUCUGGCCCAACCACAC |
| 1237 | GUAAGGUUGACCAUACUCUAC |

In some embodiments, the first and second sequence are present on a single stranded polynucleotide, wherein the first sequence and second sequence are separated by 4, 5, 6, 7, 8, 9, 10, 11, 12, 13, 14, or 15 nucleotides, wherein the 4, 5, 6, 7, 8, 9, 10, 11, 12, 13, 14, or 15 nucleotides form a loop region in the shRNA. In some embodiments, the loop region comprises a sequence selected from the sequences set forth in Table 16.

TABLE 16

Illustrative loop region sequences

| SEQ ID NO | Loop Region Sequence |
|---|---|
| 1238 | CGAA |
| 1239 | UUCAAGA |
| 1240 | AUAUUCA |
| 1241 | UGUGCUGUC |
| 1242 | CUCGAG |
| 1243 | CUUCCUGUCAGA |
| 1244 | CUUCCCUUUGUCAGA |
| 1245 | GUGUUAUUCUUG |
| 1246 | GUGUCUUAAUUG |
| 1247 | GUGUUAGUCUUG |
| 1248 | UCAAGAG |
| 1249 | GGACAUCCAGGG |
| 1250 | GUGAAGCCACAGAUG |
| 1251 | GAUUCUAAAA | shRNAs of the disclosure may be generated exogenously by chemical synthesis, by in vitro transcription, or by cleavage of longer double-stranded RNA with Dicer or another appropriate nuclease with similar activity. Chemically synthesized siRNAs, produced from protected ribonucleoside phosphoramidites using a conventional DNA/RNA synthesizer, may be obtained from commercial suppliers such as Millipore Sigma (Houston, Tex.), Ambion Inc. (Austin, Tex.). Invitrogen (Carlsbad, Calif.), or Dharmacon (Lafayette, Colo.). siRNAs can be purified by extraction with a solvent or resin, precipitation, electrophoresis, chromatography, or a combination thereof, for example. Alternatively, siRNAs may be used with little if any purification to avoid losses due to sample processing.

In some embodiments, shRNAs of the disclosure can be produced using an expression vector into which a nucleic acid encoding the double stranded RNA has been cloned, for example under control of a suitable promoter.

Pharmaceutical Compositions

The disclosure provides pharmaceutical compositions comprising immune cells comprising the first and second receptors of the disclosure and a pharmaceutically acceptable diluent, carrier or excipient.

Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; and preservatives.

In some embodiments, the immune cell expresses both the first receptor and the second receptor. In some embodiments, at least about 50%, about 55%, about 60%, about 65%, about 70%, about 75%, about 80%, about 85%, about 90%, or about 95% of the immune cells express both the first receptor and the second receptor. In some embodiments, at least 90% of the immune cells express both the first receptor and the second receptor.

Treating Cancer

Provided herein are methods of killing a plurality of cancer cells, or treating cancer, in a subject, comprising administering to the subject a therapeutically effective amount of a composition comprising immune cells comprising the first and second receptors of the disclosure. The immune cells express both receptors in the same cell.

Cancer is a disease in which abnormal cells divide without control and spread to nearby tissue. In some embodiments, the cancer comprises a liquid tumor or a solid tumor. Exemplary liquid tumors include leukemias and lymphomas. Cancers can arise in virtually an organ in the body, including epithelial tissues. Any cancer wherein a plurality of the cancer cells express the first, activator, ligand and do not express the second, inhibitor ligand is envisaged as within the scope of the instant disclosure. For example, MSLN positive cancers that can be treated using the methods described herein include mesothelioma, ovarian cancer, cervical cancer, uterine cancer, gastric cancer, pancreatic cancer, lung cancers such as lung adenocarcinomas, colorectal cancer and cholangiocarcinoma.

In some embodiments, the plurality of cancer cells express the target antigen. In some embodiments, the plurality cancer cells of the subject express MSLN. MSNL positive cancers include mesothelioma cancer, ovarian cancer, cervical cancer, colorectal cancer, esophageal cancer, head and neck cancer, kidney cancer, uterine cancer, gastric cancer, pancreatic cancer, lung cancer, lung adenocarcinomas, colorectal cancer, or cholangiocarcinoma, as well as other solid epithelial tumors. Further cancers that express MSLN include relapsed, refractory or metastatic gastric, esophageal, head and neck and kidney cancers. In some embodiments, the MSLN positive cancer comprises an epithelial tumor, for example a carcinoma.

Provided herein are methods of treating MSLN+ cancer in a subject having a MSLN+ tumor, the tumor having loss of heterozygosity at an MHC class I locus. In some embodiments, the methods comprise administering to the subject an effective amount of the immune cells or pharmaceutical compositions described herein. In some embodiments, the methods comprise (a) determining HLA-A, HLA-B, or HLA-C genotype or expression of normal cells and a plurality of cancer cells of the subject; (b) determining the expression of MSLN in a plurality of cancer cells of the subject; and (c) administering to the subject an effective amount of the immune cells or pharmaceutical compositions of the disclosure if the normal cells express an HLA-A, HLA-B or HLA-C non-target antigen and the plurality of cancer cells do not express the HLA-A, HLA-B or HLA-C non-target antigen, and the plurality of cancer cells are also MSLN-positive. In some embodiments, for example those embodiments where the cancer is known to be MSLN+, the methods comprise (a) determining HLA-A, HLA-B or HLA-C genotype or expression of normal cells and a plurality of cancer cells of the subject; and (b) administering to the subject an effective amount of the immune cells or pharmaceutical compositions of the disclosure if the normal cells express an HLA-A, HLA-B or HLA-C non-target antigen and the plurality of cancer cells do not express the non-target antigen. In some embodiments, the non-target antigen comprises HLA-A*02, HLA-A*01, HLA-A*03, HLA-A*11, HLA-B*07 or HLA-C*07.

In some embodiments, a plurality of cancer cells do not express a polymorphic allele of ICAM1, COMT or CXCL16. For example, the cancer cells have lost an allele of CAM1, COMT or CXCL16 through loss of heterozygosity at that locus.

In some embodiments, the plurality of cancer cells do not express, or have lower expression than normal cells, of LRRN4 or UPK3B.

The disclosure provides methods of treating a cancer in a subject comprising: (a) determining the genotype of normal cells and a plurality of cancer cells of the subject at a polymorphic locus selected from the group consisting of a polymorphic locus of ICAM1, a polymorphic locus of COMT and a polymorphic locus of CXCL16; (b) determining the expression of MSLN in a plurality of cancer cells; and (c) administering a plurality of immune cells to the subject if the normal cells are heterozygous for the polymorphic locus and the plurality of cancer cells are hemizygous for the polymorphic locus, and the plurality of cancer cells are MSLN positive, wherein the plurality of immune cells comprise: (i) a first receptor, optionally a chimeric antigen receptor (CAR) or T cell receptor (TCR), comprising an extracellular ligand binding domain specific to MSLN, or a peptide antigen thereof in a complex with a major histocompatibility complex class I (MHC-I); and (ii) a second receptor, optionally an inhibitory chimeric antigen receptor, comprising an extracellular ligand binding specific to a non-target antigen selected from ICAM1, COMT, and CXCL16, or an antigen peptide thereof in a complex with an a major histocompatibility complex class I (MHC-I), wherein the non-target antigen comprises a polymorphism.

Methods of genotyping cancer cells and normal cells from a subject for the presence or absence of SNPs will be readily apparent to persons of ordinary skill in the art. SNP genotyping methods include, inter alia, PCR based methods such as dual-probe TaqMan assays, array based hybridization methods and sequencing.

Methods of measuring the expression of the target antigen in cancer or normal cells from a subject will be readily apparent to persons of ordinary skill in the art. These include, inter alia, methods of measuring RNA expression such as RNA sequencing and reverse transcription polymerase chain reaction (RT-PCR), as well as methods of measuring protein expression such as immunohistochemistry based methods. Methods of measuring loss of heterozygosity in a plurality of cancer cells, include, inter alia, high throughput sequencing of genomic DNA extracted from cancer cells using methods known in the art.

The disclosure provides methods of treating a cancer in a subject comprising measuring the expression level of the non-target antigen in a plurality of cancer cells, and treating the subject when the expression level of the non-target antigen in the plurality of cancer cells is less than the expression level of the non-target antigen in the plurality of cancer cells is less than the expression level of the non-target antigen a plurality of healthy cells. In some embodiments, the non-target antigen comprises LRRN4 or UPKB3, or a peptide antigen of LRRN4 or UPKB3. In some embodiments, the methods comprise determining the expression of MSLN in a plurality of cancer cells; and administering a plurality of immune cells to the subject if the plurality of cancer cells have low or no expression of the non-target antigen, and the plurality of cancer cells are MSLN positive. Methods of measuring the expression of the target antigen in cancer or cells from a subject will be readily apparent to persons of ordinary skill in the art. These include, inter alia, methods of measuring RNA expression such as RNA sequencing and reverse transcription polymerase chain reaction (RT-PCR), as well as methods of measuring protein expression such as immunohistochemistry based methods.

In some embodiments, the immune cells are T cells.

In some embodiments, the immune cells are allogeneic or autologous.

In some embodiments, the second receptor increases the specificity of the immune cells for the MSLN positive cancer cells compared to immune cells that express the first receptor but do not express the second receptor. In some embodiments, the immune cells have reduced side effects compared to immune cells that express the first receptor but do not express the second receptor.

Administration of the immune cells or pharmaceutical compositions described herein can arrest the growth of a tumor in the subject. For example, the immune cells or pharmaceutical compositions can kill tumor cells, so that the tumor stops growing, or is reduced in size. In some cases, immune cells or pharmaceutical compositions can prevent formation of additional tumors, or reduce the total number of tumors in the subject.

Administration of the immune cells or pharmaceutical compositions described herein can result in selective killing of a cancer cell but not a wild-type cell in the subject. In some embodiments, about 60% of the cells killed are cancer cells, about 65% of the cells killed are cancer cells, about 70% of the cells killed are cancer cells, about 75% of the cells killed are cancer cells, about 80% of the cells killed are cancer cells, about 85% of the cells killed are cancer cells, about 90% of the cells killed are cancer cells, about 95% of the cells killed are cancer cells, or about 100% of the cells killed are cancer cells.

Administration of the immune cells or pharmaceutical compositions described herein can result in the killing of about 40%, about 50%, about 60%, about 70%, about 80%, about 90% or all of the cancer cells of the subject.

Administration of the immune cells or pharmaceutical compositions described herein can result in fewer side effects for the subject than administration of an otherwise equivalent immune cell comprising the first activator receptor but no second inhibitory receptor. For example, administering the immune cells or pharmaceutical compositions described herein can reduce dose limited toxicity relative to the MSLN CAR, or MSLN TCR administered without the second inhibitory receptor.

Treating cancer can result in a reduction in size of a tumor. A reduction in size of a tumor may also be referred to as "tumor regression". Preferably, after treatment, tumor size is reduced by 5% or greater relative to its size prior to treatment; more preferably, tumor size is reduced by 10% or greater; more preferably, reduced by 20% or greater; more preferably, reduced by 30% or greater; more preferably, reduced by 40% or greater; even more preferably, reduced by 50% or greater; and most preferably, reduced by greater than 75% or greater. Size of a tumor may be measured by any reproducible means of measurement. The size of a tumor may be measured as a diameter of the tumor.

Treating cancer can result in a reduction in tumor volume. Preferably, after treatment, tumor volume is reduced by 5% or greater relative to its size prior to treatment; more preferably, tumor volume is reduced by 10% or greater; more preferably, reduced by 20% or greater; more preferably, reduced by 30% or greater; more preferably, reduced by 40% or greater; even more preferably, reduced by 50% or greater; and most preferably, reduced by greater than 75% or greater. Tumor volume may be measured by any reproducible means of measurement.

Administration of the immune cells or pharmaceutical compositions described herein can reduce the size of a tumor in the subject. In some embodiments, the size of the tumor is reduced by about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, or about 100%, relative to the size of the tumor before administration of the immune cells or pharmaceutical compositions. In some embodiments, the tumor is eliminated.

Treating cancer results in a decrease in number of tumors. Preferably, after treatment, tumor number is reduced by 5% or greater relative to number prior to treatment; more preferably, tumor number is reduced by 10% or greater; more preferably, reduced by 20% or greater; more preferably, reduced by 30% or greater; more preferably, reduced by 40% or greater; even more preferably, reduced by 50% or greater; and most preferably, reduced by greater than 75%. Number of tumors may be measured by any reproducible means of measurement. The number of tumors may be measured by counting tumors visible to the naked eye or at a specified magnification. Preferably, the specified magnification is 2×, 3×, 4×, 5×, 10×, or 50×.

Treating cancer can result in a decrease in number of metastatic lesions in other tissues or organs distant from the primary tumor site. Preferably, after treatment, the number of metastatic lesions is reduced by 5% or greater relative to number prior to treatment; more preferably, the number of metastatic lesions is reduced by 10% or greater; more preferably, reduced by 20% or greater; more preferably, reduced by 30% or greater; more preferably, reduced by 40% or greater; even more preferably, reduced by 50% or greater; and most preferably, reduced by greater than 75%. The number of metastatic lesions may be measured by any reproducible means of measurement. The number of metastatic lesions may be measured by counting metastatic lesions visible to the naked eye or at a specified magnification. Preferably, the specified magnification is 2×, 3×, 4×, 5×, 10×, or 50×.

Treating cancer can result in an increase in average survival time of a population of treated subjects in comparison to a population receiving carrier alone. Preferably, the average survival time is increased by more than 30 days; more preferably, by more than 60 days; more preferably, by more than 90 days; and most preferably, by more than 120 days. An increase in average survival time of a population may be measured by any reproducible means. An increase in average survival time of a population may be measured, for example, by calculating for a population the average length of survival following initiation of treatment with an active compound. An increase in average survival time of a population may also be measured, for example, by calculating for a population the average length of survival following completion of a first round of treatment with an active compound.

Treating cancer can result in an increase in average survival time of a population of treated subjects in comparison to a population of untreated subjects. Preferably, the average survival time is increased by more than 30 days; more preferably, by more than 60 days; more preferably, by more than 90 days; and most preferably, by more than 120 days. An increase in average survival time of a population may be measured by any reproducible means. An increase in average survival time of a population may be measured, for example, by calculating for a population the average length of survival following initiation of treatment with an active compound. An increase in average survival time of a population may also be measured, for example, by calculating for a population the average length of survival following completion of a first round of treatment with an active compound.

Treating cancer can result in increase in average survival time of a population of treated subjects in comparison to a population receiving monotherapy with a drug that is not a compound of the present disclosure, or a pharmaceutically acceptable salt, prodrug, metabolite, analog or derivative thereof. Preferably, the average survival time is increased by more than 30 days; more preferably, by more than 60 days; more preferably, by more than 90 days; and most preferably, by more than 120 days. An increase in average survival time of a population may be measured by any reproducible means. An increase in average survival time of a population may be measured, for example, by calculating for a population the average length of survival following initiation of treatment with an active compound. An increase in average survival time of a population may also be measured, for example, by calculating for a population the average length of survival following completion of a first round of treatment with an active compound.

Treating cancer can result in a decrease in the mortality rate of a population of treated subjects in comparison to a population receiving carrier alone. Treating cancer can result in a decrease in the mortality rate of a population of treated subjects in comparison to an untreated population. Treating cancer can result in a decrease in the mortality rate of a population of treated subjects in comparison to a population receiving monotherapy with a drug that is not a compound of the present disclosure, or a pharmaceutically acceptable salt, prodrug, metabolite, analog or derivative thereof. Preferably, the mortality rate is decreased by more than 2%; more preferably, by more than 5%; more preferably, by more than 10%; and most preferably, by more than 25%. A decrease in the mortality rate of a population of treated subjects may be measured by any reproducible means. A decrease in the mortality rate of a population may be measured, for example, by calculating for a population the average number of disease-related deaths per unit time following initiation of treatment with an active compound. A decrease in the mortality rate of a population may also be measured, for example, by calculating for a population the average number of disease-related deaths per unit time following completion of a first round of treatment with an active compound.

Treating cancer can result in a decrease in tumor growth rate. Preferably, after treatment, tumor growth rate is reduced by at least 5% relative to number prior to treatment; more preferably, tumor growth rate is reduced by at least 10%; more preferably, reduced by at least 20%; more preferably, reduced by at least 30%; more preferably, reduced by at least 40%; more preferably, reduced by at least 50%; even more preferably, reduced by at least 50%; and most preferably, reduced by at least 75%. Tumor growth rate may be measured by any reproducible means of measurement. Tumor growth rate can be measured according to a change in tumor diameter per unit time.

Treating cancer can result in a decrease in tumor regrowth. Preferably, after treatment, tumor regrowth is less than 5%; more preferably, tumor regrowth is less than 10%; more preferably, less than 20%; more preferably, less than 30%; more preferably, less than 40%; more preferably, less than 50%; even more preferably, less than 50%; and most preferably, less than 75%. Tumor regrowth may be measured by any reproducible means of measurement. Tumor regrowth is measured, for example, by measuring an increase in the diameter of a tumor after a prior tumor shrinkage that followed treatment. A decrease in tumor regrowth is indicated by failure of tumors to reoccur after treatment has stopped.

Treating or preventing a cancer can result in a reduction in the rate of cellular proliferation. Preferably, after treatment, the rate of cellular proliferation is reduced by at least 5%; more preferably, by at least 10%; more preferably, by at least 20%; more preferably, by at least 30%; more preferably, by at least 40%; more preferably, by at least 50%; even more preferably, by at least 50%; and most preferably, by at least 75%. The rate of cellular proliferation may be measured by any reproducible means of measurement. The rate of cellular proliferation is measured, for example, by measuring the number of dividing cells in a tissue sample per unit time.

Treating or preventing cancer can result in a reduction in the proportion of proliferating cells. Preferably, after treatment, the proportion of proliferating cells is reduced by at least 5%; more preferably, by at least 10%; more preferably, by at least 20%; more preferably, by at least 30%; more preferably, by at least 40%; more preferably, by at least 50%; even more preferably, by at least 50%; and most preferably, by at least 75%. The proportion of proliferating cells may be measured by any reproducible means of measurement. Preferably, the proportion of proliferating cells is measured, for example, by quantifying the number of dividing cells relative to the number of nondividing cells in a tissue sample. The proportion of proliferating cells can be equivalent to the mitotic index.

Treating or preventing cancer can result in a decrease in size of an area or zone of cellular proliferation. Preferably, after treatment, size of an area or zone of cellular proliferation is reduced by at least 5% relative to its size prior to treatment; more preferably, reduced by at least 10%; more preferably, reduced by at least 20%; more preferably, reduced by at least 30%; more preferably, reduced by at least 40%; more preferably, reduced by at least 50%; even more preferably, reduced by at least 50%; and most preferably, reduced by at least 75%. Size of an area or zone of cellular proliferation may be measured by any reproducible means of measurement. The size of an area or zone of cellular proliferation may be measured as a diameter or width of an area or zone of cellular proliferation.

Treating or preventing cancer can result in a decrease in the number or proportion of cells having an abnormal appearance or morphology. Preferably, after treatment, the number of cells having an abnormal morphology is reduced by at least 5% relative to its size prior to treatment; more preferably, reduced by at least 10%; more preferably, reduced by at least 20%; more preferably, reduced by at least 30%; more preferably, reduced by at least 40%; more preferably, reduced by at least 50%; even more preferably, reduced by at least 50%; and most preferably, reduced by at least 75%. An abnormal cellular appearance or morphology may be measured by any reproducible means of measurement. An abnormal cellular morphology can be measured by microscopy, e.g., using an inverted tissue culture microscope. An abnormal cellular morphology can take the form of nuclear pleiomorphism.

Dosage and Administration

The immune cells and of the present disclosure may be administered in a number of ways depending upon whether local or systemic treatment is desired.

In general, administration may be parenteral.

Methods for administration of cells for adoptive cell therapy are known and may be used in connection with the provided methods and compositions. For example, adoptive T cell therapy methods are described, e.g., in US Patent Application Publication No. 2003/0170238 to Gruenberg et al and U.S. Pat. No. 4,690,915 to Rosenberg.

The compositions of the disclosure are suitable for parenteral administration. As used herein, "parenteral administration" of a pharmaceutical composition includes any route of administration characterized by physical breaching of a tissue of a subject and administration of the pharmaceutical composition through the breach in the tissue, thus generally resulting in the direct administration into the blood stream, into muscle, or into an internal organ. Parenteral administration thus includes, but is not limited to, administration of a pharmaceutical composition by injection of the composition, by application of the composition through a surgical incision, by application of the composition through a tissue-penetrating non-surgical wound, and the like. In particular, parenteral administration is contemplated to include, but is not limited to, subcutaneous, intraperitoneal, intramuscular, intrasternal, intravenous, intraarterial, intrathecal, intraventricular, intraurethral, intracranial, intratumoral, intrasynovial injection or infusions; and kidney dialytic infusion techniques. In some embodiments, parenteral administration of the compositions of the present disclosure comprises intravenous or intraarterial administration.

The disclosure provides pharmaceutical compositions comprising a plurality of immune cells of the disclosure, and a pharmaceutically acceptable carrier, diluent or excipient.

Formulations of a pharmaceutical composition suitable for parenteral administration typically generally comprise of immune cells combined with a pharmaceutically acceptable carrier, such as sterile water or sterile isotonic saline. Such formulations may be prepared, packaged, or sold in a form suitable for bolus administration or for continuous administration. Injectable formulations may be prepared, packaged, or sold in unit dosage form, such as in ampoules or in multi-dose containers containing a preservative. Formulations for parenteral administration include, but are not limited to, suspensions, solutions, emulsions in oily or aqueous vehicles, pastes, and the like. Such formulations may further comprise one or more additional ingredients including, but not limited to, suspending, stabilizing, or dispersing agents. Parenteral formulations also include aqueous solutions which may contain excipients such as salts, carbohydrates and buffering agents. Exemplary parenteral administration forms include solutions or suspensions in sterile aqueous solutions, for example, aqueous propylene glycol or dextrose solutions. Such dosage forms can be suitably buffered, if desired. Formulations for parenteral administration may be formulated to be immediate and/or modified release. Modified release formulations include delayed-, sustained-, pulsed-, controlled-, targeted and programmed release.

In some embodiments, the formulated composition comprising the immune cells is suitable for administration via injection. In some embodiments, the formulated composition comprising the immune cells is suitable for administration via infusion.

The pharmaceutical compositions of the present disclosure, which may conveniently be presented in unit dosage form, may be prepared according to conventional techniques well known in the pharmaceutical industry. Such techniques include the step of bringing into association the immune cells with the pharmaceutical carrier(s) or excipient(s), such as liquid carriers.

Aqueous suspensions may further contain substances that increase the viscosity of the suspension including, for example, sodium carboxymethylcellulose, sorbitol and/or dextran. The suspension may also contain stabilizers.

The compositions of the present disclosure may additionally contain other adjunct components conventionally found in pharmaceutical compositions. Thus, for example, the compositions may contain additional, compatible, pharmaceutically-active materials such as, for example, antipruritics, astringents, local anesthetics or anti-inflammatory agents, or may contain additional materials useful in physically formulating various dosage forms of the compositions of the present disclosure, such as dyes, preservatives, antioxidants, opacifiers, thickening agents and stabilizers. However, such materials, when added, should not unduly interfere with the biological activities of the immune cells of the compositions of the present disclosure.

The formulation or composition may also contain more than one active ingredient useful for the particular indication, disease, or condition being treated with the immune cells, where the respective activities do not adversely affect one another. Such active ingredients are suitably present in combination in amounts that are effective for the purpose intended.

Thus, in some embodiments, the pharmaceutical composition further includes other pharmaceutically active agents or drugs, such as chemotherapeutic agents.

The pharmaceutical composition in some aspects can employ time-released, delayed release, and sustained release delivery systems such that the delivery of the composition occurs prior to, and with sufficient time to cause, sensitization of the site to be treated. Many types of release delivery systems are available and known. Such systems can avoid repeated administrations of the composition, thereby increasing convenience to the subject and the physician.

Administration can be effected in one dose, continuously or intermittently throughout the course of treatment. Single or multiple administrations can be carried out with the dose level and pattern being selected by the treating physician.

The pharmaceutical composition in some embodiments contains the immune cells in amounts effective to treat or prevent a cancer, such as a therapeutically effective or prophylactically effective amount. Therapeutic or prophylactic efficacy in some embodiments is monitored by periodic assessment of treated subjects. For repeated administrations over days, weeks or months, depending on the condition, the treatment can be repeated until a desired suppression of cancer signs or symptoms occurs. However, other dosage regimens may be useful and can be determined. The desired dosage can be delivered by a single bolus administration or infusion of the composition or by multiple bolus administrations or infusions of the composition.

The cells or population of cells can be administrated in one or more doses. In some embodiments, an effective amount of cells can be administrated as a single dose. In some embodiments, an effective amount of cells can be administrated as more than one doses over a period time. Timing of administration is within the judgment of a managing physician and depends on the clinical condition of the patient.

The cells or population of cells may be obtained from any source, such as a blood bank or a donor, or the patient themselves.

An effective amount means an amount which provides a therapeutic or prophylactic benefit. The dosage administered will be dependent upon the age, health and weight of the recipient, kind of concurrent treatment, if any, frequency of treatment and the nature of the effect desired. In some embodiments, an effective amount of cells or composition comprising those cells are administrated parenterally. In some embodiments, administration can be an intravenous administration. In some embodiments, administration can be directly done by injection within a tumor.

For purposes of the disclosure, an assay, which comprises, for example, comparing the extent to which target cells are lysed or one or more cytokines are secreted by immune cells expressing the receptors, upon administration of a given dose of such immune cells to a mammal, among a set of mammals of which is each given a different dose of the immune cells, can be used to determine a starting dose to be administered to a mammal.

In some embodiments, the cells are administered as part of a combination treatment, such as simultaneously with or sequentially with, in any order, another therapeutic intervention, such as an antibody or engineered cell or receptor or agent, such as a cytotoxic or therapeutic agent. The immune cells of the disclosure are in some embodiments are co-administered with one or more additional therapeutic agents or in connection with another therapeutic intervention, either simultaneously or sequentially in any order. In some contexts, the immune cells are co-administered with another therapy sufficiently close in time such that the immune cell populations enhance the effect of one or more additional therapeutic agents, or vice versa. In some embodiments, the immune cells are administered prior to the one or more additional therapeutic agents. In some embodiments, the immune cells are administered after to the one or more additional therapeutic agents.

In embodiments, a lymphodepleting chemotherapy is administered to the subject prior to, concurrently with, or after administration (e.g., infusion) of adoptive immune cells. In an example, the lymphodepleting chemotherapy is administered to the subject prior to administration of the immune cells. For example, the lymphodepleting chemotherapy ends 1-4 days (e.g., 1, 2, 3, or 4 days) prior to adoptive cell infusion. In embodiments, multiple doses of adoptive cells are administered, e.g., as described herein. In embodiments, a lymphodepleting chemotherapy is administered to the subject prior to, concurrently with, or after administration (e.g., infusion) of the immune cells described herein. Examples of lymphodepletion include, but may not be limited to, nonmyeloablative lymphodepleting chemotherapy, myeloablative lymphodepleting chemotherapy, total body irradiation, etc. Examples of lymphodepleting agents include, but are not limited to, antithymocyte globulin, anti-CD3 antibodies, anti-CD4 antibodies, anti-CD8 antibodies, anti-CD52 antibodies, anti-CD2 antibodies, TCRαβ blockers, anti-CD20 antibodies, anti-CD19 antibodies, Bortezomib, rituximab, anti-CD 154 antibodies, rapamycin, CD3 immunotoxin, fludarabine, cyclophosphamide, busulfan, melphalan, Mabthera, Tacrolimus, alefacept, alemtuzumab, OKT3, OKT4, OKT8, OKT11, fingolimod, anti-CD40 antibodies, anti-BR3 antibodies, Campath-1H, anti-CD25 antibodies, calcineurin inhibitors, mycophenolate, and steroids, which may be used alone or in combination. As a further example, a lymphodepletion regimen can include, administration of alemtuzumab, cyclophosphamide, benduamustin, rituximab, pentostatin, and/or fludarabine. Lymphodepletion regimen can be administered in one or more cycles until the desired outcome of reduced circulating immune cells. In some embodiments, the lymphodepletion comprises administering an agent that specifically targets, and reduces or eliminates CD52+ cells in the subject, and the immune cells are modified to reduce or eliminate CD52 expression.

In some embodiments, an immune stimulating therapy is administered to the subject prior to, concurrently with, or after administration (e.g. infusion) of adoptive immune cells. In some embodiments, the immune stimulating therapy comprises homeostatic cytokines. In some embodiments, the immune stimulating therapy comprises immune-stimulatory molecules. In some embodiments, the immune stimulating therapy comprises IL-2, IL-7, IL-12, IL-15, IL-21, IL-9, or a functional fragment thereof. In some embodiments, the immune stimulating therapy comprises IL-2, IL-7, IL-12, IL-15, IL-21, IL-9, or combinations thereof. In some embodiments, the immune stimulating therapy comprises IL-2, or a functional fragment thereof.

Methods for adoptive cell therapy using autologous cells includes isolating immune cells from patient blood, performing a series of modifications on the isolated cells including transducing the cells with one or more vectors encoding the dual receptor system described herein, and administering the cells to a patient. Providing immune cells from a subject suffering from or at risk for cancer or a hematological malignancy requires isolation of immune cell from the patient's blood, and can be accomplished through methods known in the art, for example, by leukapheresis. During leukapheresis, blood from a subject is extracted and the peripheral blood mononuclear cells (PBMCs) are separated, and the remainder of the blood is returned to the subject's circulation. The PBMCs are stored either frozen or cryopreserved as a sample of immune cells and provided for further processing steps, such as, e.g. the modifications described herein.

In some embodiments, the method of treating a subject described herein comprises modifications to immune cells from the subject comprising a series of modifications comprising enrichment and/or depletion, activation, genetic modification, expansion, formulation, and cryopreservation.

The disclosure provides enrichment and/or depletion steps that can be, for example, washing and fractionating methods known in the art for preparation of subject PBMCs for downstream procedures, e.g. the modifications described herein. For example, without limitation, methods can include devices to remove gross red blood cells and platelet contaminants, systems for size-based cell fractionation for the depletion of monocytes and the isolation of lymphocytes, and/or systems that allow the enrichment of specific subsets of T cells, such as, e.g. CD4+, CD8+, CD25+, or CD62L+ T cells. Following the enrichment steps, a target sub-population of immune cells will be isolated from the subject PMBCs for further processing. Those skilled in the art will appreciate that enrichment steps, as provided herein, may also encompass any newly discovered method, device, reagent or combination thereof.

The disclosure provides activation steps that can be any method known in the art to induce activation of immune cells, e.g. T cells, required for their ex vivo expansion. Immune cell activation can be achieved, for example, by culturing the subject immune cells in the presence of dendritic cells, culturing the subject immune cells in the presence of artificial antigen-presenting cells (AAPCs), or culturing the immune cells in the presence of irradiated K562-derived AAPCs. Other methods for activating subject immune cells can be, for example, culturing the immune cells in the presence of isolated activating factors and compositions, e.g. beads, surfaces, or particles functionalized with activating factors. Activating factors can include, for example, antibodies, e.g. anti-CD3 and/or anti-CD28 antibodies. Activating factors can also be, for example, cytokines, e.g. interleukin (IL)-2 or IL-21. Activating factors can also be costimulatory molecules, such as, for example, CD40, CD40L, CD70, CD80, CD83, CD86, CD137L, ICOSL, GITRL, and CD134L. Those skilled in the art will appreciate that activating factors, as provided herein, may also encompass any newly discovered activating factor, reagent, composition, or combination thereof that can activate immune cells.

The disclosure provides genetic modification steps for modifying the subject immune cells. In some embodiments, the genetic modification comprises transducing the immune cell with a vector comprising a shRNA described herein complementary to B2M or HLA-A. In some embodiments, the genetic modification comprises modifying the genome of the immune cells to induce mutations in B2M or HLA-A using CRISPR/Cas mediated genome engineering. In some embodiments, the method comprises transducing the immune cell with one or more vectors encoding the activator and inhibitory receptors, thereby producing immune cells expressing the activator and inhibitory receptors.

The disclosure provides expansion steps for the genetically modified subject immune cells. Genetically modified subject immune cells can be expanded in any immune cell expansion system known in the art to generate therapeutic doses of immune cells for administration. For example, bioreactor bags for use in a system comprising controller pumps, and probes that allow for automatic feeding and waste removal can be used for immune cell expansion. Cell culture flasks with gas-permeable membranes at the base may be used for immune cell expansion. Any such system known in the art that enables expansion of immune cells for clinical use is encompassed by the expansion step provided herein. Immune cells are expanded in culture systems in media formulated specifically for expansion. Expansion can also be facilitated by culturing the immune cell of the disclosure in the presence of activation factors as described herein. Those skilled in the art will appreciate that expansion steps, as provided herein, may also encompass any newly discovered culture systems, media, or activating factors that can be used to expand immune cells.

The disclosure provides formulation and cryopreservation steps for the expanded genetically modified subject immune cells. Formulation steps provided include, for example, washing away excess components used in the preparation and expansion of immune cells of the methods of treatment described herein. Any pharmaceutically acceptable formulation medium or wash buffer compatible with immune cell known in the art may be used to wash, dilute/concentration immune cells, and prepare doses for administration. Formulation medium can be acceptable for administration of the immune cells, such as, for example crystalloid solutions for intravenous infusion. Cryopreservation can optionally be used to store immune cells long-term. Cryopreservation can be achieved using known methods in the art, including for example, storing cells in a cryopreservation medium containing cryopreservation components. Cryopreservation components can include, for example, dimethyl sulfoxide or glycerol. Immune cells stored in cryopreservation medium can be cryopreserved by reducing the storage temperature to −80° C. to −196° C.

In some embodiments, the method of treatment comprises determining the HLA germline type of the subject. In some embodiments, the HLA germline type is determined in bone marrow.

In some embodiments, the method of treatment comprises determining the level of expression of MSLN. In some embodiments, the level of expression of MSLN is determined in tumor tissue samples from the subject. In some embodiments, the expression level of MSLN is determined using next generation sequencing. In some embodiments, the expression level of MSLN is determined using RNA sequencing. In some embodiments, the level of MSLN is determined using immunohistochemistry.

In some embodiments, the method of treatment comprises administering a therapeutically effective dose of immune cells comprising an HLA-A*02 inhibitory receptor to a subject in need thereof, wherein the subject is determined to be HLA germline HLA-A*02 heterozygous and have cancer cells with loss of HLA-A*02. In some embodiments, the method of treatment comprises administering a therapeutically effective dose of immune cells comprising an HLA-A*01 inhibitory receptor to a subject in need thereof, wherein the subject is determined to be HLA germline HLA-A*01 heterozygous and have cancer cells with loss of HLA-A*01. In some embodiments, the method of treatment comprises administering a therapeutically effective dose of immune cells comprising an HLA-A*03 to a subject in need thereof, wherein the subject is determined to be HLA germline HLA-A*03 heterozygous and have cancer cells with loss of HLA-A*03. In some embodiments, the method of treatment comprises administering a therapeutically effective dose of immune cells comprising an HLA-A*07 inhibitory receptor to a subject in need thereof, wherein the subject is determined to be HLA germline HLA-A*07 heterozygous and have cancer cells with loss of HLA-A*07. In some embodiments, the method of treatment comprises administering a therapeutically effective dose of immune cells comprising an HLA-C*07 inhibitory receptor to a subject in need thereof, wherein the subject is determined to be HLA germline HLA-C*07 heterozygous and have cancer cells with and loss of HLA-C*07. In some embodiments, the method of treatment comprises administering a therapeutically effective dose of immune cells comprising an HLA-B*07 inhibitory receptor in a subject in need thereof, wherein the subject is determined to be HLA germline HLA-B*07 heterozygous and have cancer cells with loss of HLA-B*07.

In various embodiments, the disclosure provides method of treatment of heterozygous HLA-A*02 patients with malignancies that express MSLN and have lost HLA-A*02 expression; and/or of treatment of heterozygous HLA-A*02 adult patients with recurrent unresectable or metastatic solid tumors that express MSLN and have lost HLA-A*02 expression.

In some embodiments, a therapeutically effective dose of the immune cells described herein are administered. In some embodiments, the immune cells of the disclosure are administered by intravenous injection. In some embodiments, the immune cells of the disclosure are administered by intraperitoneal injection. In some embodiments, a therapeutically effective dose comprises about $0.5 \times 10^6$ cells, about $1 \times 10^6$ cells, about $2 \times 10^6$ cells, about $3 \times 10^6$ cells, $4 \times 10^6$ cells, about $5 \times 10^6$ cells, about $6 \times 10^6$ cells, about $7 \times 10^6$ cells, about $8 \times 10^6$ cells, about $9 \times 10^6$ cells, about $1 \times 10^7$, about $2 \times 10^7$, about $3 \times 10^7$, about $4 \times 10^7$, about $5 \times 10^7$, about $6 \times 10^7$, about $7 \times 10^7$, about $8 \times 10^7$, about $9 \times 10^7$, about $1 \times 10^8$ cells, about $2 \times 10^8$ cells, about $3 \times 10^8$ cells, about $4 \times 10^8$ cells, about $5 \times 10^8$ cells, about $6 \times 10^8$ cells, about $7 \times 10^8$ cells, about $8 \times 10^8$ cells, about $9 \times 10^8$ cells, about $1 \times 10^9$ cells, about $2 \times 10^9$ cells, about $3 \times 10^9$ cells, about $3 \times 10^9$ cells, about $4 \times 10^9$ cells, about $5 \times 10^9$ cells, about $5 \times 10^9$ cells, about $6 \times 10^9$ cells, about $7 \times 10^9$ cells, about $8 \times 10^9$ cells, about $9 \times 10^9$ cells, about $1 \times 10^{10}$ cells, about $2 \times 10^{10}$ cells, about $3 \times 10^{10}$ cells, about $4 \times 10^{10}$ cells, about $5 \times 10^{10}$ cells, about $6 \times 10^{10}$ cells, about $7 \times 10^{10}$ cells, about $8 \times 10^{10}$ cells, or about $9 \times 10^{10}$ cells.

In some embodiments, a therapeutically effective dose comprises about $0.5 \times 10^6$ cells to about $9 \times 10^{10}$ cells, about $1 \times 10^6$ cells to about $5 \times 10^{10}$ cells, about $2 \times 10^6$ cells to about $5 \times 10^9$ cells, about $3 \times 10^6$ cells to about $5 \times 10^9$ cells, about $4 \times 10^6$ cells to about $3 \times 10^9$ cells, about $5 \times 10^6$ cells to about $2 \times 10^9$ cells, about $6 \times 10^6$ cells to about $1 \times 10^9$ cells, $0.5 \times 10^6$ cells to about $6 \times 10^9$ cells, about $1 \times 10^6$ cells to about $5 \times 10^9$ cells, about $2 \times 10^6$ cells to about $5 \times 10^9$ cells, about $3 \times 10^6$ cells to about $4 \times 10^9$ cells, about $4 \times 10^6$ cells to about $3 \times 10^9$ cells, about $5 \times 10^6$ cells to about $2 \times 10^9$ cells, about $6 \times 10^6$ cells to about $1 \times 10^9$ cells, $0.5 \times 10^6$ cells to about $6 \times 10^8$ cells, about $1 \times 10^6$ cells to about $5 \times 10^8$ cells, about $2 \times 10^6$ cells to about $5 \times 10^8$ cells, about $3 \times 10^6$ cells to about $4 \times 10^8$ cells, about $4 \times 10^6$ cells to about $3 \times 10^8$ cells, about $5 \times 10^6$ cells to about $2 \times 10^8$ cells, about $6 \times 10^6$ cells to about $1 \times 10^8$ cells, about $7 \times 10^6$ cells to about $9 \times 10^8$ cells, about $8 \times 10^6$ cells to about $8 \times 10^8$ cells, about $9 \times 10^6$ cells to about $7 \times 10^8$ cells, about $1 \times 10^7$ cells to about $6 \times 10^8$ cells, about $2 \times 10^7$ cells to about $5 \times 10^8$ cells, about $7 \times 10^6$ cells to about $9 \times 10^7$ cells, about $8 \times 10^6$ cells to about $8 \times 10^7$ cells, about $9 \times 10^6$ cells to about $7 \times 10^7$ cells, about $1 \times 10^7$ cells to about $6 \times 10^7$ cells, or about $2 \times 10^7$ cells to about $5 \times 10^7$ cells.

In some embodiments, a therapeutically effective dose comprises about $0.5 \times 10^5$ cells to about $9 \times 10^{10}$ cells. In some embodiments, a therapeutically effective dose comprises about $0.5 \times 10^6$ cells to about $1 \times 10^{10}$ cells. In some embodiments, a therapeutically effective dose comprises about $0.5 \times 10^6$ cells to about $5 \times 10^9$ cells. In some embodiments, a therapeutically effective dose comprises about $0.5 \times 10^6$ cells to about $1 \times 10^9$ cells. In some embodiments, a therapeutically effective dose comprises about $0.5 \times 10^6$ cells to about $6 \times 10^8$ cells. In some embodiments, a therapeutically effective dose comprises about $0.5 \times 10^6$ cells to about $9 \times 10^{10}$ cells. In some embodiments, a therapeutically effective dose comprises about $0.5 \times 10^7$ cells to about $1 \times 10^{10}$ cells. In some embodiments, a therapeutically effective dose comprises about $0.5 \times 10^7$ cells to about $5 \times 10^9$ cells. In some embodiments, a therapeutically effective dose comprises about 0.5×10⁷ cells to about 1×10⁹ cells. In some embodiments, a therapeutically effective dose comprises about 0.5×10⁷ cells to about 6×10⁸ cells. In some embodiments, a therapeutically effective dose comprises about 0.5×10⁸ cells to about 9×10¹⁰ cells. In some embodiments, a therapeutically effective dose comprises about 0.5×10⁸ cells to about 1×10¹⁰ cells. In some embodiments, a therapeutically effective dose comprises about 0.5×10⁸ cells to about 5×10⁹ cells. In some embodiments, a therapeutically effective dose comprises about 0.5×10⁸ cells to about 1×10⁹ cells. The term "about" as referred to in a therapeutically dose, can be, for example, ±0.5×10⁶ cells, ±0.5×10⁷ cells, or ±0.5×10⁸ cells.

Kits and Articles of Manufacture

The disclosure provides kits and articles of manufacture comprising the polynucleotides and vectors encoding the receptors described herein, and immune cells comprising the receptors described herein. In some embodiments, the kit comprises articles such as vials, syringes and instructions for use.

In some embodiments, the kit comprises a polynucleotide or vector comprising a sequence encoding one or more receptors of the disclosure.

In some embodiments, the kit comprises a plurality of immune cells comprising the first and second receptors as described herein. In some embodiments, the plurality of immune cells comprises a plurality of T cells.

In some embodiments, the kit further comprises instructions for use.

ENUMERATED EMBODIMENTS

The disclosure can be understood with reference to the following illustrative, enumerated embodiments:

1. An immune cell responsive to loss of heterozygosity in a cancer cell, comprising:
   a. a first receptor, optionally a chimeric antigen receptor (CAR) or T cell receptor (TCR), comprising an extracellular ligand binding domain specific to a target antigen selected from:
      i. a cancer cell-specific antigen, or a peptide antigen thereof in a complex with a major histocompatibility complex class I (MHC-I); or
      ii. Mesothelin (MSLN), or a peptide antigen thereof in a complex with a major histocompatibility complex class I (MHC-I); and
   b. a second receptor, optionally an inhibitory chimeric antigen receptor, comprising an extracellular ligand binding domain specific to a non-target antigen selected from ICAM1, COMT, and CXCL16, or a peptide antigen thereof in a complex with a major histocompatibility complex class I (MHC-I), wherein the non-target antigen comprises a polymorphism.

2. The immune cell of embodiment 1, wherein the non-target antigen is lost from the cancer cell through loss of heterozygosity (LOH).

3. The immune cell of embodiment 1 or 2, wherein the non-target antigen is an ICAM1 antigen that shares at least 95% identity to SEQ ID NO: 27 and the polymorphism comprises a K or E at position 469 of SEQ ID NO: 27.

4. The immune cell of embodiment 1 or 2, wherein the non-target antigen is a COMT antigen that shares at least 95% identity to SEQ ID NO: 28 and the polymorphism comprises a V or M at position 158 of SEQ ID NO: 28.

5. The immune cell of embodiment 1 or 2, wherein the non-target antigen is a CXCL16 antigen that shares at least 95% identity to SEQ ID NO: 29 and the polymorphism is selected from the group consisting of:
   a. an I or Tat position 142 of SEQ ID NO: 29; and
   b. an A or V at position 200 of SEQ ID NO: 29.

6. The immune cell of any one of embodiments 1-5, wherein the non-target antigen is expressed in a non-target cell.

7. The immune cell of any one of embodiments 1-6, wherein the non-target cell expresses both target antigen and the non-target antigen.

8. An immune cell responsive to low or no expression of a protein in a cancer cell, comprising:
   a. a first receptor, optionally a chimeric antigen receptor (CAR) or T cell receptor (TCR), comprising an extracellular ligand binding domain specific to a target antigen selected from:
      i. a cancer cell-specific antigen, or a peptide antigen thereof in a complex with a major histocompatibility complex class I (MHC-I); or
      ii. MSLN, or a peptide antigen thereof in a complex with a major histocompatibility complex class I (MHC-I); and
   b. a second receptor, optionally an inhibitory chimeric antigen receptor, comprising an extracellular ligand binding domain specific to a non-target antigen selected from LRRN4 and UPK3B, or peptide antigen thereof in a complex with a major histocompatibility complex class I (MHC-I), wherein the non-target antigen is expressed at a lower level by the cancer cell than by a non-target cell.

9. The immune cell of embodiment 8, wherein the non-target antigen is not expressed by the cancer cell.

10. The immune cell of embodiment 9, wherein the non-target cell expresses both the target antigen and the non-target antigen.

11. The immune cell of any one of embodiments 1-10, wherein the target antigen is a cancer cell-specific antigen.

12. The immune cell of embodiment 11, wherein the target antigen is a peptide antigen of a cancer cell-specific antigen in a complex with a major histocompatibility complex class I (MHC-I).

13. The immune cell of any one of embodiments 1-12, wherein the cancer cell is a mesothelioma cancer cell, an ovarian cancer cell, a cervical cancer cell, a colorectal cancer cell, an esophageal cancer cell, a head and neck cancer cell, a kidney cancer cell, an uterine cancer cell, a gastric cancer cell, a pancreatic cancer cell, a lung cancer cell, a colorectal cancer cell or a cholangiocarcinoma cell.

14. The immune cell of any one of embodiments 1-13, wherein the cancer cell expresses MSLN.

15. The immune cell of any one of embodiments 1-14, wherein the first receptor and the second receptor together specifically activate the immune cell in the presence of the cancer cell.

16. The immune cell of embodiment 15, wherein the immune cell is a T cell.

17. The immune cell of embodiment 16, wherein the T cell is a CD8+CD4− T cell.

18. The immune cell of any one of embodiments 1-17, wherein the MSLN comprises a sequence that shares at least 95% identity to SEQ ID NO: 1 or SEQ ID NO: 2.

19. The immune cell of any one of embodiments 1-18, wherein the first receptor is a T cell receptor (TCR).

20. The immune cell of any one of embodiments 1-18, wherein the first receptor is a chimeric antigen receptor (CAR).

21. The immune cell of embodiment 19 or 20, wherein the extracellular ligand binding domain of the first receptor comprises an antibody fragment, a single chain Fv antibody fragment (scFv), a β chain variable domain (Vβ), or a TCR α chain variable domain and a TCR β chain variable domain.

22. The immune cell of embodiment 19 or 20, wherein the extracellular ligand binding domain comprises an scFv.

23. The immune cell of embodiment 22, wherein the scFv comprises a sequence selected from the group consisting of SEQ ID NOs: 3-6, or a sequence having at least 85%, at least 90%, at least 95%, at least 97% or at least 99% identity thereto.

24. The immune cell of embodiment 22, wherein the scFv comprises or consists essentially of a sequence selected from the group consisting of SEQ ID NOs: 3-6.

25. An immune cell responsive to loss of heterozygosity in a cancer cell, comprising:
a. a first receptor, optionally a chimeric antigen receptor (CAR) or T cell receptor (TCR), comprising an extracellular ligand binding domain specific to Mesothelin (MSLN), or a peptide antigen thereof in a complex with a major histocompatibility complex class I (MHC-I); and
b. a second receptor, optionally an inhibitory chimeric antigen receptor, comprising an extracellular ligand binding domain specific to a non-target antigen, wherein the non-target antigen comprises HLA-A*02.

26. The immune cell of embodiment 25, wherein the extracellular ligand binding domain of the first receptor comprises an antibody fragment, a single chain Fv antibody fragment (scFv), a β chain variable domain (Vβ), or a TCR α chain variable domain and a TCR β chain variable domain.

27. The immune cell of embodiment 25, wherein the extracellular ligand binding domain of the first receptor comprises an scFv.

28. The immune cell of embodiment 27, wherein the scFv comprises a sequence selected from the group consisting of SEQ ID NOs: 3-6, or a sequence having at least 85%, at least 90%, at least 95%, at least 97% or at least 99% identity thereto.

28. The immune cell of embodiment 27, wherein the scFv comprises or consists essentially of a sequence selected from the group consisting of SEQ ID NOs: 3-6.

29. The immune cell of any one of embodiments 25-28, wherein the extracellular ligand binding domain of the second receptor comprises an antibody fragment, a single chain Fv antibody fragment (scFv), a β chain variable domain (Vβ), or a TCR α chain variable domain and a TCR β chain variable domain.

30. The immune cell of any one of embodiments 25-28, wherein the extracellular ligand binding domain of the second receptor comprises an scFv.

31. The immune cell of embodiment 30, wherein the scFv comprises a sequence having at least 85%, at least 90%, at least 95%, at least 97% or at least 99% identity to any one of SEQ ID NOs: 30-41.

32. The immune cell of embodiment 30, wherein the scFv comprises or consists essentially of a sequence of any one of SEQ ID NOs: 30-41.

33. The immune cell of any one of embodiments 25-32, wherein the extracellular ligand binding domain of the second receptor comprises CDRs selected from the group consisting of SEQ ID NOs: 42-53.

34. The immune cell of any one of embodiments 25-33, wherein the second receptor comprises a LILRB1 intracellular domain or a functional variant thereof.

35. The immune cell of embodiment 34, wherein the LILRB1 intracellular domain comprises a sequence at least 95% identical to SEQ ID NO: 65.

36. The immune cell of any one of embodiments 25-35, wherein the second receptor comprises a LILRB1 transmembrane domain or a functional variant thereof.

37. The immune cell of embodiment 36, wherein the LILRB1 transmembrane domain or a functional variant thereof comprises a sequence at least 95% identical to SEQ ID NO: 74.

38. The immune cell of any one of embodiments 25-37, wherein the second receptor comprises a LILRB1 hinge domain or functional fragment or variant thereof.

39. The immune cell of embodiment 38, wherein the LILRB1 hinge domain comprises a sequence at least 95% identical to SEQ ID NO: 73, SEQ ID NO: 66, SEQ ID NO: 67, SEQ ID NOS: 81-84, or SEQ ID NOS: 90-91.

40. The immune cell of any one of embodiments 25-39, wherein the second receptor comprises a LILRB1 intracellular domain and a LILRB1 transmembrane domain, or a functional variant thereof.

41. The immune cell of embodiment 40, wherein the LILRB1 intracellular domain and LILRB1 transmembrane domain comprises SEQ ID NO: 69 or a sequence at least 95% identical to SEQ ID NO: 69.

42. The immune cell of any one of embodiments 25-41, wherein the cancer cell is a mesothelioma cancer cell, an ovarian cancer cell, a cervical cancer cell, a colorectal cancer cell, an esophageal cancer cell, a head and neck cancer cell, a kidney cancer cell, an uterine cancer cell, a gastric cancer cell, a pancreatic cancer cell, a lung cancer cell, a colorectal cancer cell or a cholangiocarcinoma cell.

43. wherein the cancer cell is a colorectal cancer cell.

44. The immune cell of any one of embodiments 25-43, wherein the cancer expresses MSLN.

45. The immune cell of any one of embodiments 25-44, wherein the cancer cell does not express HLA-A*02.

46. The immune cell of any one of embodiments 25-45, wherein non-target cells express MSLN and HLA-A*02.

47. The immune cell of any one of embodiments 25-46, wherein the first receptor and the second receptor together specifically activate the immune cell in the presence of the target cell.

48. The immune cell of embodiment 47, wherein the immune cell is a T cell.

49. The immune cell of embodiment 48, wherein the T cell is a CD8+CD4− T cell.

50. The immune cell of any one of embodiments 25-49, wherein the MSLN comprises a sequence that shares at least 95% identity to SEQ ID NO: 1.

51. The immune cell of any one of embodiments 25-50, wherein the first receptor is a chimeric antigen receptor (CAR) or a TCR.

52. A pharmaceutical composition, comprising a therapeutically effective amount of the immune cells of any one of embodiments 1-51.

53. The pharmaceutical composition of embodiment 52, further comprising a pharmaceutically acceptable carrier, diluent or excipient.

54. The pharmaceutical composition of embodiment 52 or 53, for use as a medicament in the treatment of cancer.

55. A polynucleotide system, comprising one or more polynucleotides comprising polynucleotide sequences encoding:
   a. a first receptor, optionally a chimeric antigen receptor (CAR) or T cell receptor (TCR), comprising an extracellular ligand binding domain specific to a target antigen selected from:
      i. a cancer cell-specific antigen, or a peptide antigen thereof in a complex with a major histocompatibility complex class I (MHC-I); or
      ii. MSLN, or a peptide antigen thereof in a complex with a major histocompatibility complex class I (MHC-I); and
   b. a second receptor, optionally an inhibitory chimeric antigen receptor, comprising an extracellular ligand binding domain specific to a non-target antigen selected from ICAM1, COMT and CXCL16, or an antigen peptide thereof in a complex with a major histocompatibility complex class I (MHC-I), wherein the non-target antigen comprises a polymorphism.

56. A polynucleotide system, comprising one or more polynucleotides comprising polynucleotide sequences encoding:
   a. a first receptor, optionally a chimeric antigen receptor (CAR) or T cell receptor (TCR), comprising an extracellular ligand binding domain specific to a target antigen selected from:
      i. a cancer cell-specific antigen, or a peptide antigen thereof in a complex with a major histocompatibility complex class I (MHC-I); or
      ii. MSLN, or a peptide antigen thereof in a complex with a major histocompatibility complex class I (MHC-I); and
   b. a second receptor, optionally an inhibitory chimeric antigen receptor, comprising an extracellular ligand binding domain specific to a non-target antigen selected from LRRN4 and UPK3B, or peptide antigen thereof in a complex with a major histocompatibility complex class I (MHC-I), wherein the non-target antigen is expressed at a lower level by the cancer cell than by a non-target cell.

57. A polynucleotide system, comprising one or more polynucleotides comprising polynucleotide sequences encoding:
   a. a first receptor, optionally a chimeric antigen receptor (CAR) or T cell receptor (TCR), comprising an extracellular ligand binding domain specific to MSLN, or a peptide antigen thereof in a complex with a major histocompatibility complex class I (MHC-I); and
   b. a second receptor, optionally an inhibitory chimeric antigen receptor, comprising an extracellular ligand binding domain specific to a non-target antigen, wherein the non-target antigen comprises HLA-A*02.

58. A vector, comprising the one or more polynucleotides of any one of embodiments 55-57.

59. A method of killing a plurality of cancer cell and/or treating cancer in a subject, comprising administering to the subject an effective amount of the immune cell of any one of embodiments 1-51 or the pharmaceutical composition of any one of embodiments 52-54.

60. The method of embodiment 59, wherein a plurality of cancer cells express the target antigen.

61. The method of embodiment 59 or 60, wherein a plurality of cancer cells do not express the non-target antigen.

62. A method of making a plurality of immune cells, comprising:
   a. providing a plurality of immune cells, and
   b. transforming the plurality of immune cells with the polynucleotide system of any one of embodiments 55-57, or the vector of embodiment 58.

63. A kit comprising the immune cell of any one of embodiments 1-51 or the pharmaceutical composition of any one of embodiments 52-54.

62. The kit of embodiment 63, further comprising instructions for use.

EXAMPLES

The following Examples are intended for illustration only and do not limit the scope of the invention. Throughout the examples, the term "blocker antigen" is used to describe embodiments of a non-target antigen.

Example 1: Identification of Differentially Expressed Blockers

Figure 14:
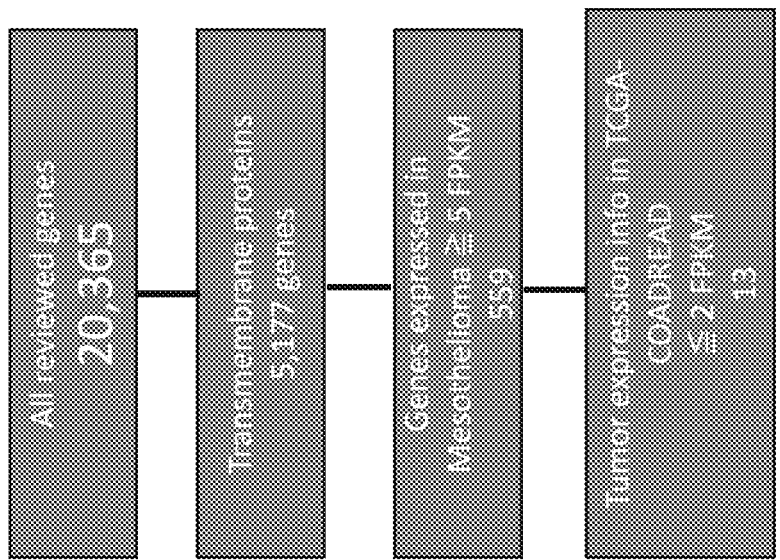
FIG. 14 is a of the bioinformatics pipeline used to identify potential inhibitory receptor targets that are not expressed in cancer cells.

Candidate blocker targets were identified using a bioinformatics pipeline. In brief, publicly available expression databases, as described below, were searched for genes with loss of expression in tumor versus normal colon tissue. These genes were filtered for membrane proteins, and for expression in the TCGA-MESO dataset (mesothelioma). A diagram of this process is shown in FIG. 14. Candidate blocker targets are expressed in the mesothelium in healthy tissues, but are not expressed in Mesothelin (MSLN) positive cancers, which include ovarian cancers and pancreatic cancers, and approximately three-quarters of lung and colorectal cancers.

In brief, the total set of human proteins was filtered to identify predicted cell surface proteins. These proteins were examined for expression using The Cancer Genome Atlas (TCGA) database. Expression of candidate genes was examined in mesotheliomas, and genes whose expression was greater than 2 transcripts per kilobase million (TPM), or greater than 5 TPM in greater than 50% of the samples in the were included for further analysis. Expression of candidate genes in colorectal, ovarian, pancreatic and lung adenocarcinoma tumors was also evaluated, and genes whose expression in these tumor types was less than 2 TPM were included for further analysis. A summary of these genes is shown in FIG. 1. FIG. 2 shows RNA expression of MSLN in normal tissues (data from the Genotype-Tissue Expression, GTEx project, gtexportal.org/home). Mesothelin is expressed in normal adipose, fallopian tube, lung and salivary gland tissues. Thus, candidate blockers that can prevent MSLN CAR or TCR T cells from targeting these tissues should also be expressed in health tissues that express MSLN.

Figure 3:
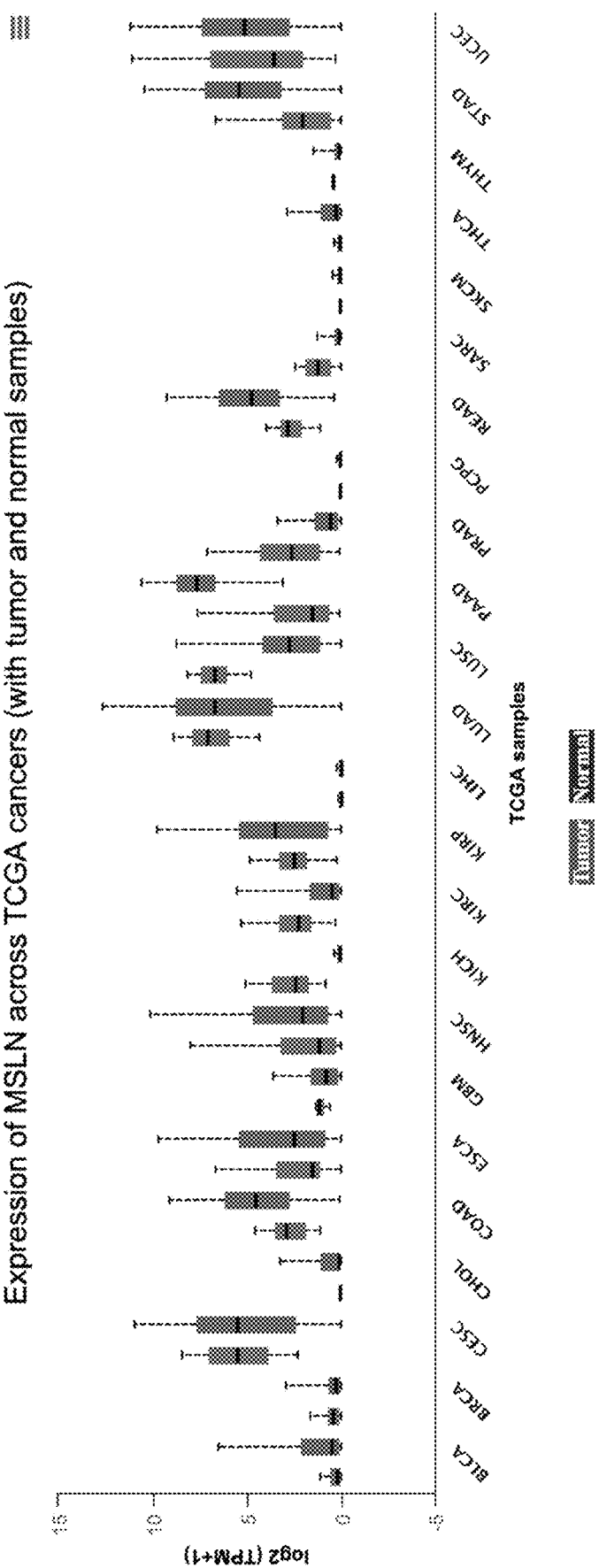
FIG. 3 is a plot showing the expression of MSLN across TCGA cancers (with tumor and normal samples.) Abbreviations: BLCA (Bladder cancer), BRCA (Breast Cancer), CESC (Cervical squamous cell carcinoma and endocervical adenocarcinoma), CHOL Cholangiocarcinoma), COAD (Colon adenocarcinoma), ESCA (Esophageal carcinoma), GBM (Glioblastoma multiforme), HNSC (Head and Neck squamous cell carcinoma), KICH (Kidney Chromophobe), KIRP (Kidney renal papillary cell carcinoma), LIHC (Liver hepatocellular carcinoma), LUAD (Lung adenocarcinoma), LUSC (Lung squamous cell carcinoma), PAAD (Pancreatic adenocarcinoma), PRAD (Prostate adenocarcinoma), PCPG (Pheochromocytoma and Paraganglioma), READ (Rectum adenocarcinoma), SARC (Sarcoma), SKCM (Skin Cutaneous Melanoma), THCA (Thyroid carcinoma), THYM (Thymoma), STAD (Stomach adenocarcinoma), UCEC (Uterine Corpus Endometrial Carcinoma).
Figure 4:
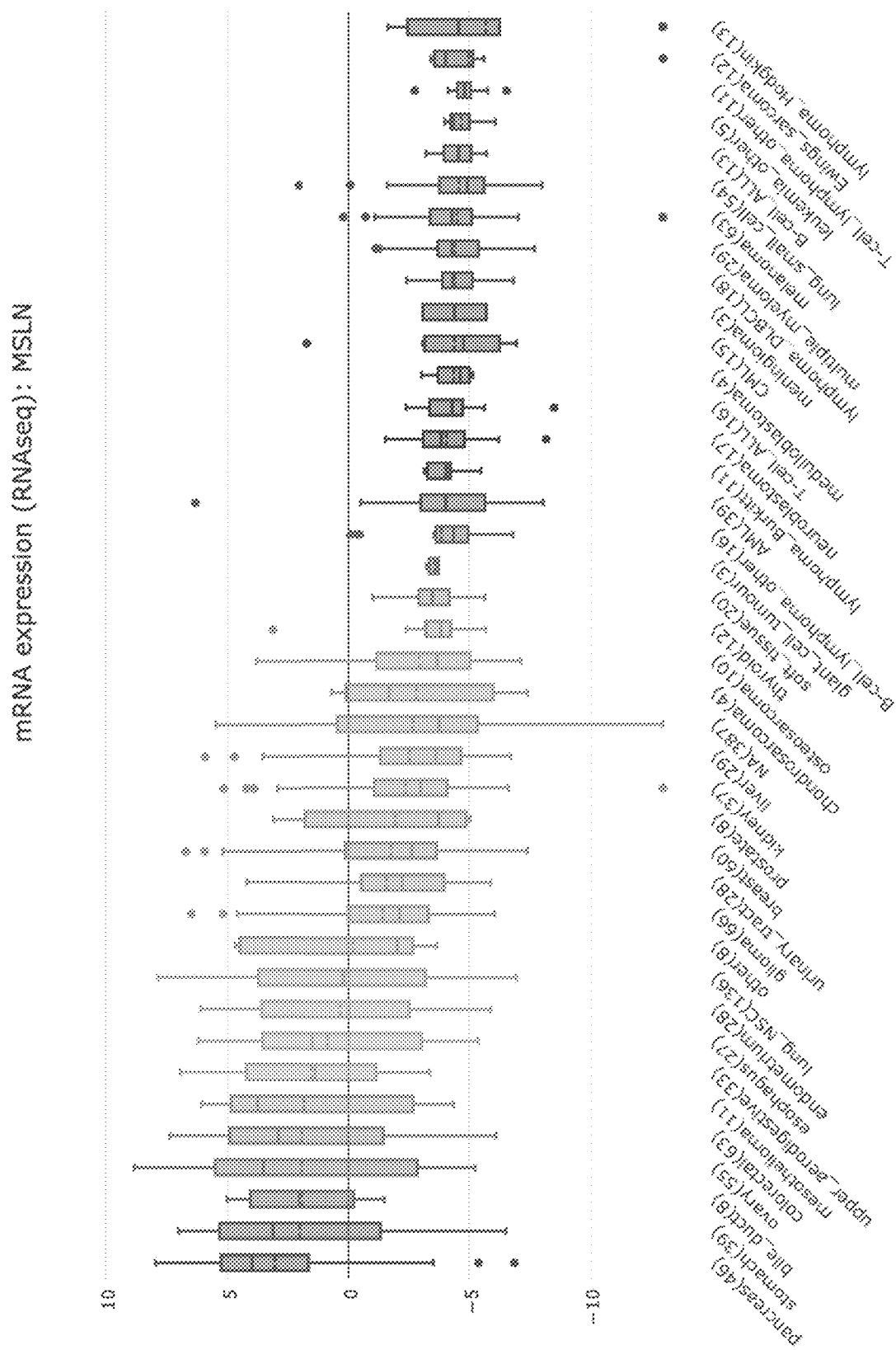
FIG. 4 is a plot showing MSLN expression in CCLE cell lines.

MSLN expression in tumor versus normal tissues was examined (FIG. 3, TCGA database). MSLN expression in a variety of cell lines was also examined (FIG. 4, Cancer Cell Line Encyclopedia, or CCLE). The cell line rank order of expression shown in FIG. 4 correlated roughly with MSLN tumor rank expression seen in FIG. 3.

Figure 5:
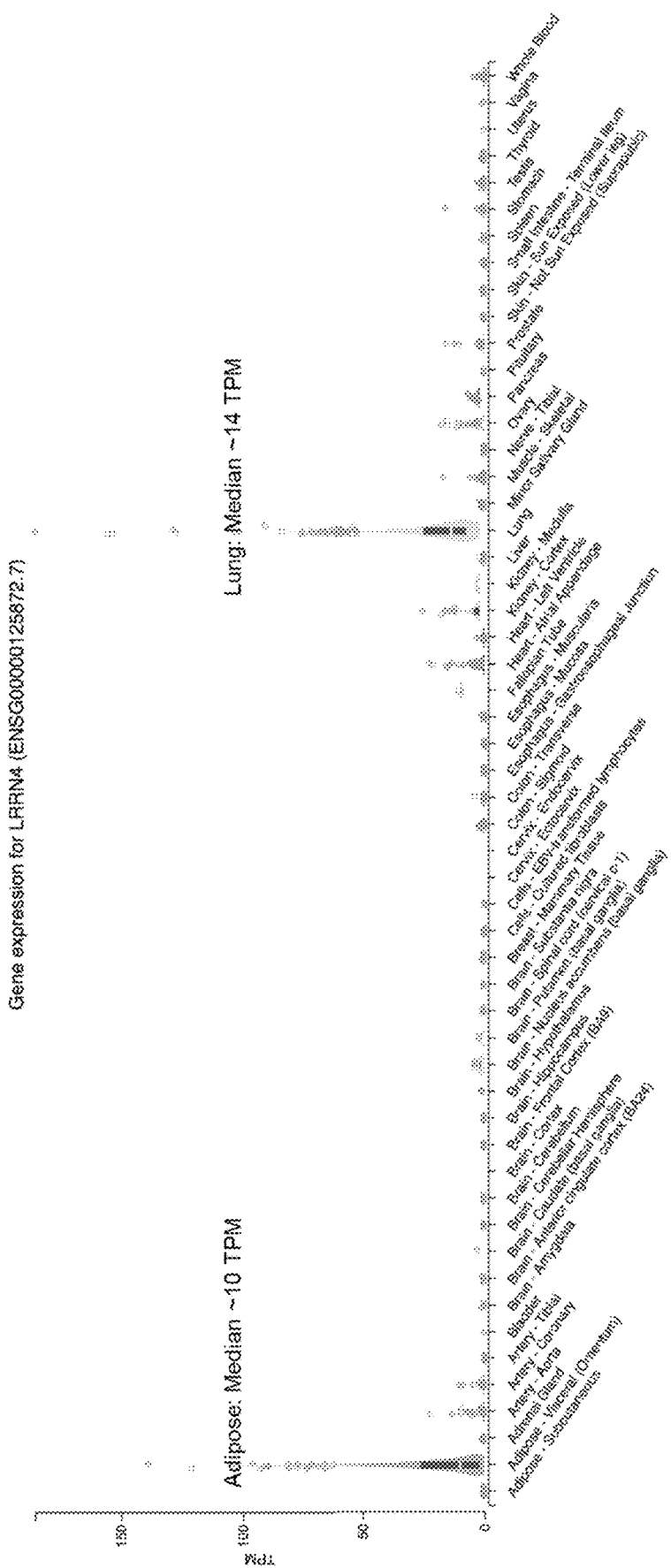
FIG. 5 is a plot showing LRRN4 expression in normal tissues.
Figure 6:
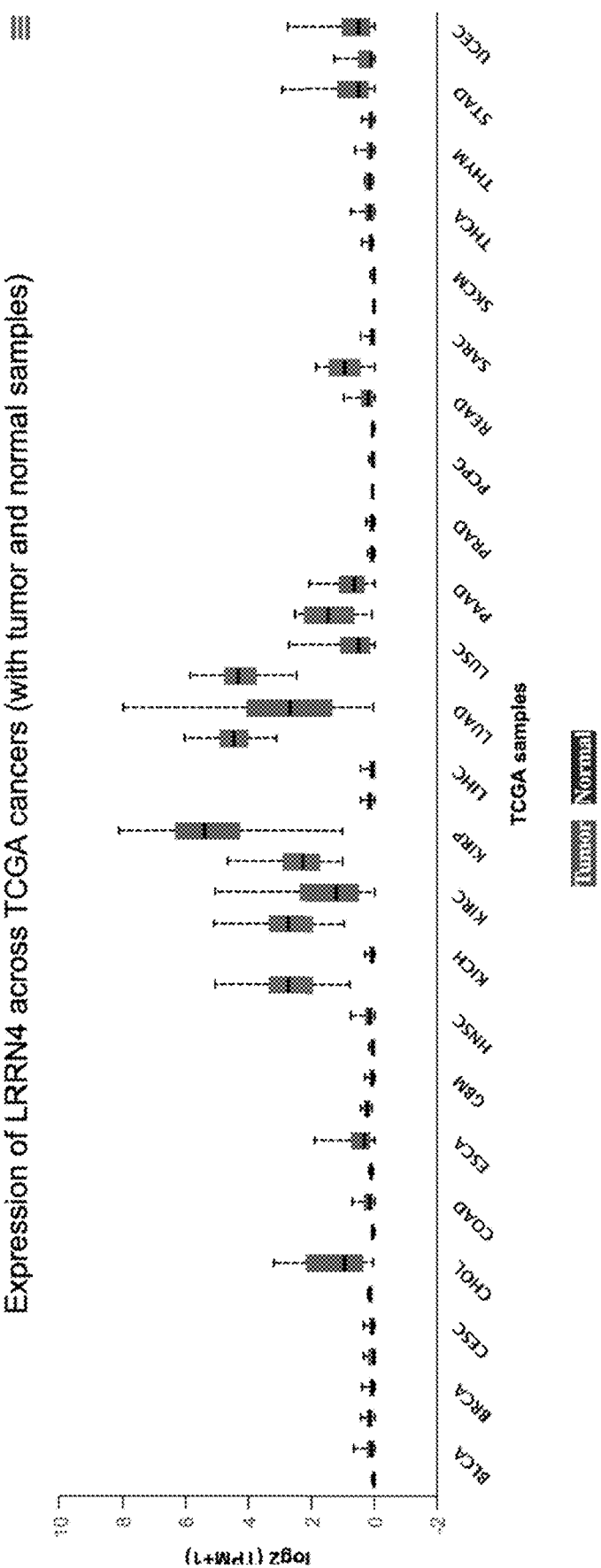
FIG. 6 is a plot showing the expression of LRRN4 across TCGA cancers (with tumor and normal samples).
Figure 7:
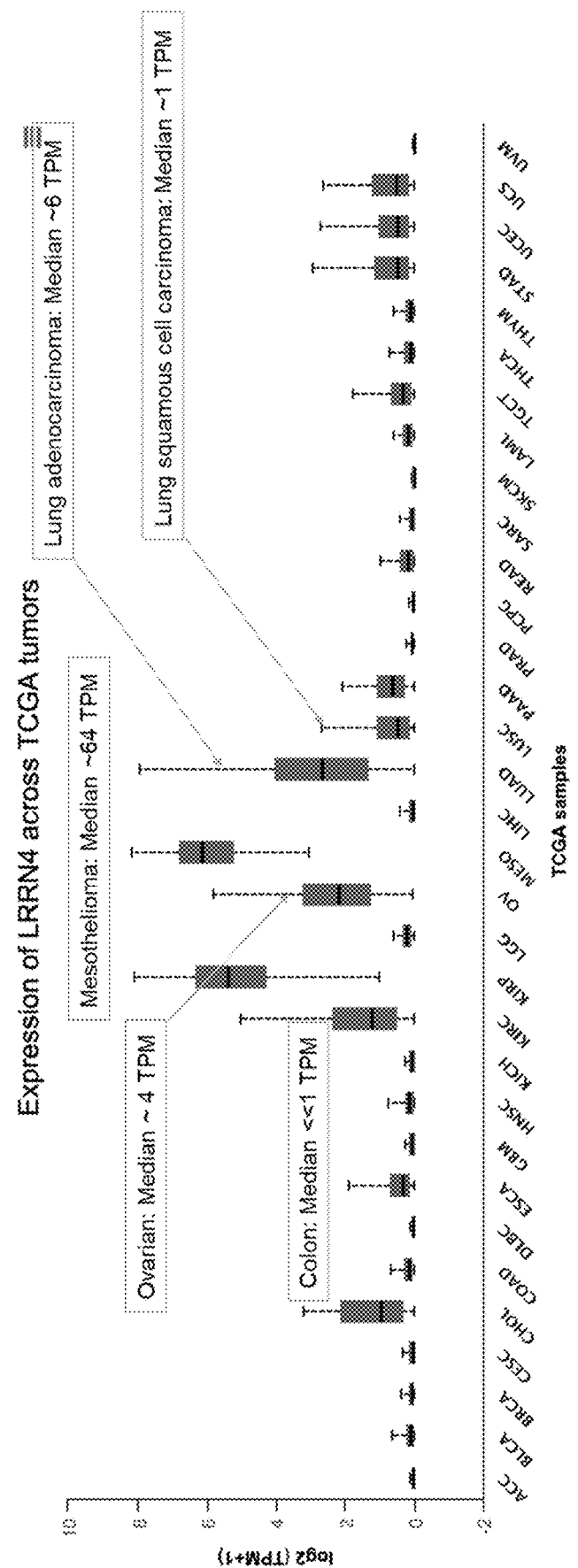
FIG. 7 is a plot showing the expression of LRRN4 across TCGA tumors.
Figure 8:
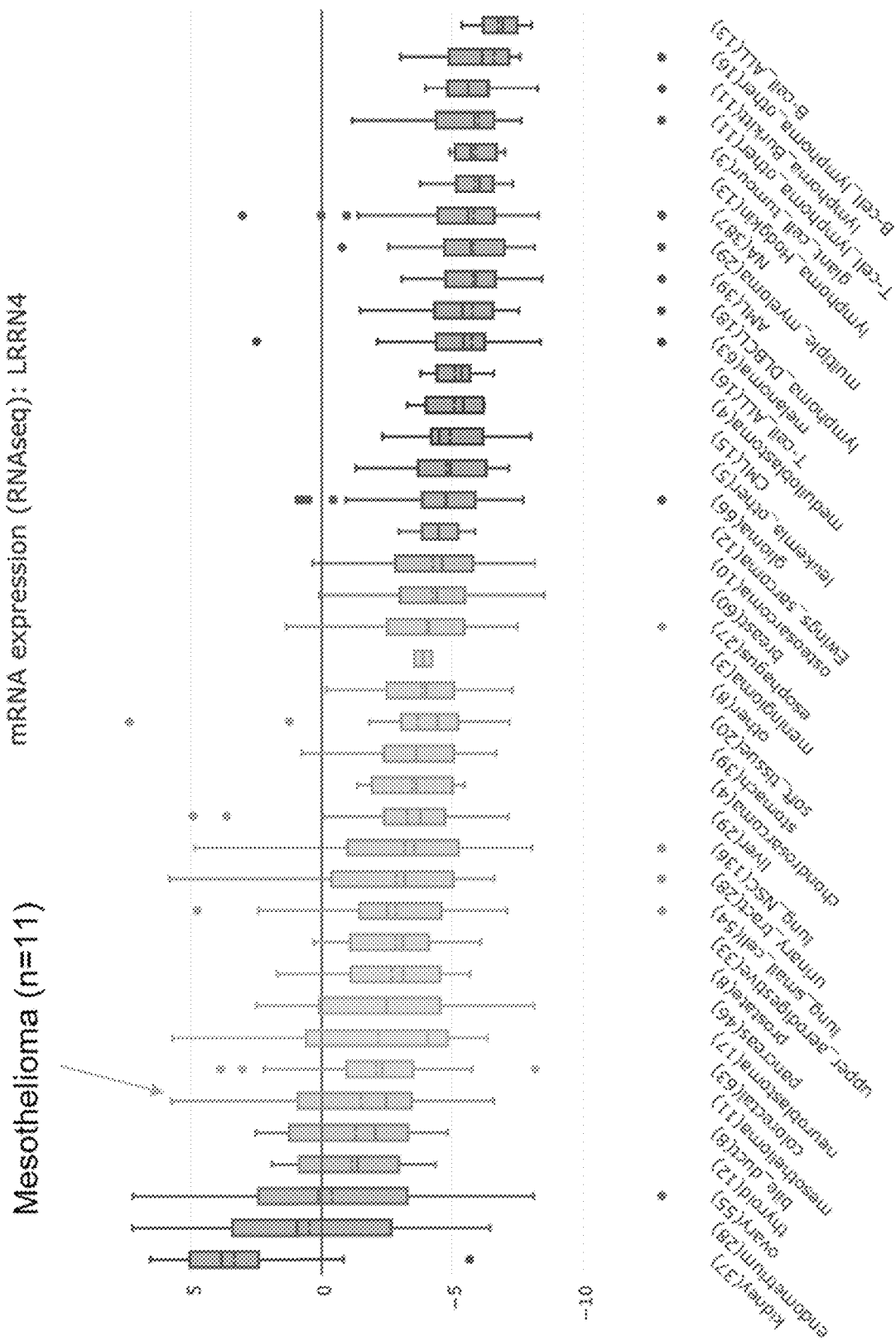
FIG. 8 is a plot showing expression of LRRN4 in CCLE cell lines.
Figure 9:
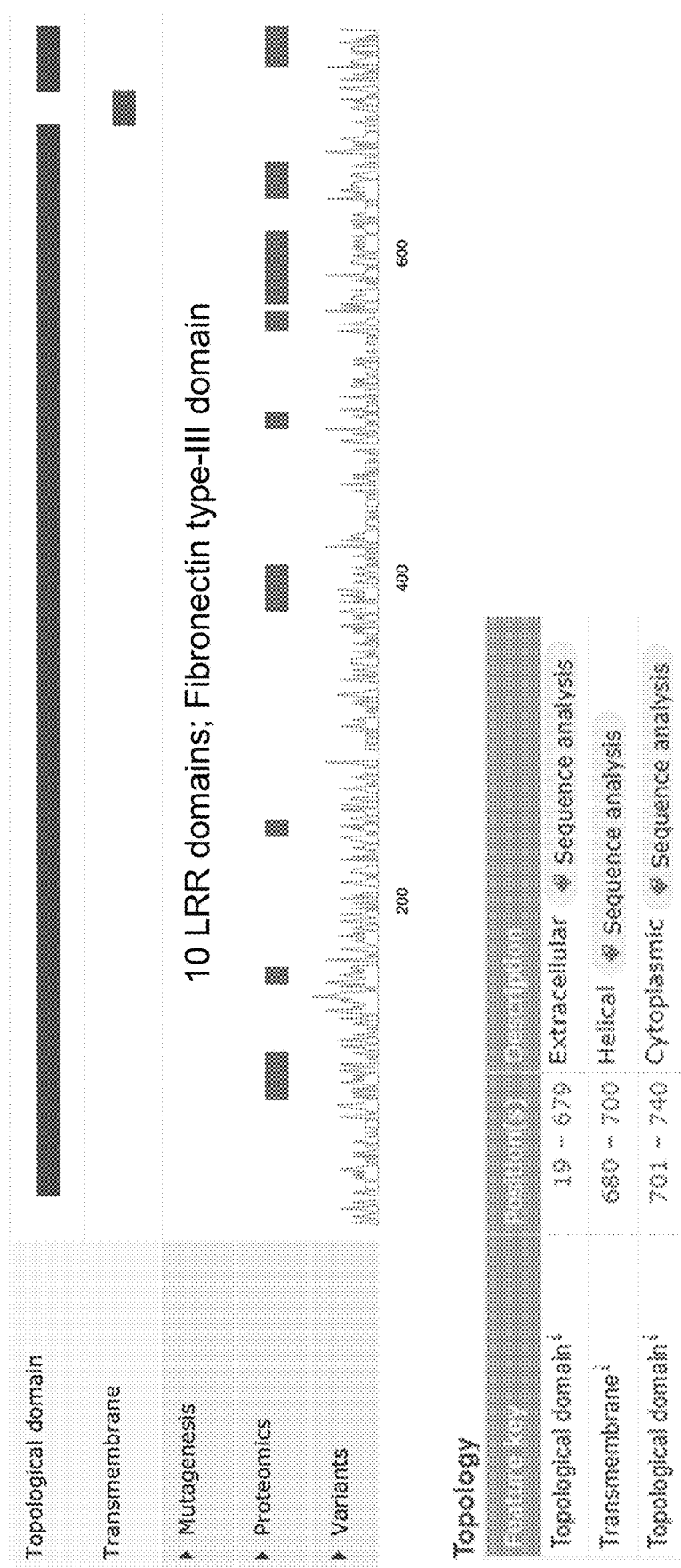
FIG. 9 is a plot showing the distribution of 10 leucine rich repeat (LRR) and Fibronectin Type III domains relative to the transmembrane domain of LRRN4. Most of these domains are likely located on the cell surface.

LRRN4 and UPK3B were identified as a candidate blocker target. FIG. 5 shows LRRN expression in normal tissues from the GTex portal (www.gtexportal.org/home/), while FIGS. 6 and 7 show LRRN4 expression in TCGA samples, and FIG. 8 shows LRRN4 expression in CCLE cell lines. As can be seen in FIGS. 5-7, LRRN4, like MSLN, is highly expressed in adipose and lung tissues. Moreover, LRRN4 has a large extracellular domain that contains multiple leucine rich repeat (LRR) and fibronectin type-III domains (FIG. 9).

Example 2: Identification of Candidate Blocker Targets Lost in Cancer Cells Due to Loss of Heterozygosity Candidate blocker targets that are lost in MSLN positive cancers due to loss of heterozygosity were identified using a bioinformatics pipeline.

The following databases were used to identify candidate blocker targets: dbSNP, a database of single nucleotide polymorphisms that includes human single nucleotide variations and small-scale insertions and deletions along with publication, population frequency, molecular consequence, and genomic mapping information. Common variations were defined as having a minor allele frequency (MAF) of greater than or equal to 0.01 in at least one major population and with at least two unrelated individuals having the minor allele in NCBI. MAF of greater than or equal to 0.1 was used as the criterion for common variations. Uniprot (The Universal Protein Resource) was used as a resource for protein sequence and annotation data hosted by EMBL-EBI, SIB and PIR. GTEx (The Genotype-Tissue Expression) was used as a public resource for tissue-specific gene expression and regulation. It contains samples from 54 non-diseased tissue sites across nearly 1000 individuals. TCGA (The Cancer Genome Atlas) was used as resource for over 20,000 primary cancer and matched normal samples spanning 33 cancer types. CCLE (Cancer cell line Encyclopedia) contains information on 57 Colorectal Cancer (CRC) cell lines. Xena UCSC has renormalized TCGA and GTEx expression data (FPKM). The Broad GDAC Firehose Legacy data was used for copy number analysis.

The NCBI dbSNP database was downloaded and searched for common variants. Only variants in chromosomes identified based on a search in the Tumor Copy number portal with high loss of heterozygosity (greater than or equal to 0.5) were included, variants with a minor allele frequency of less than 0.1 were removed. VEP (Variant Effect Predictor) was used to filter for missense variants that are in protein coding regions. Genes without transmembrane domains were removed, as were genes that are not highly expressed in mesothelioma (TCGA-MESO expression level <5 TPM). Genes with an LOH frequency of less than or equal to 0.5 were removed. Genes expressed Golgi, ER, Nucleus, Cytoplasm, Mitochondrion, helical, Lysosome, and as propeptides were removed. LOH frequency was checked in the TCGA Copy Number Portal.

Figure 13:
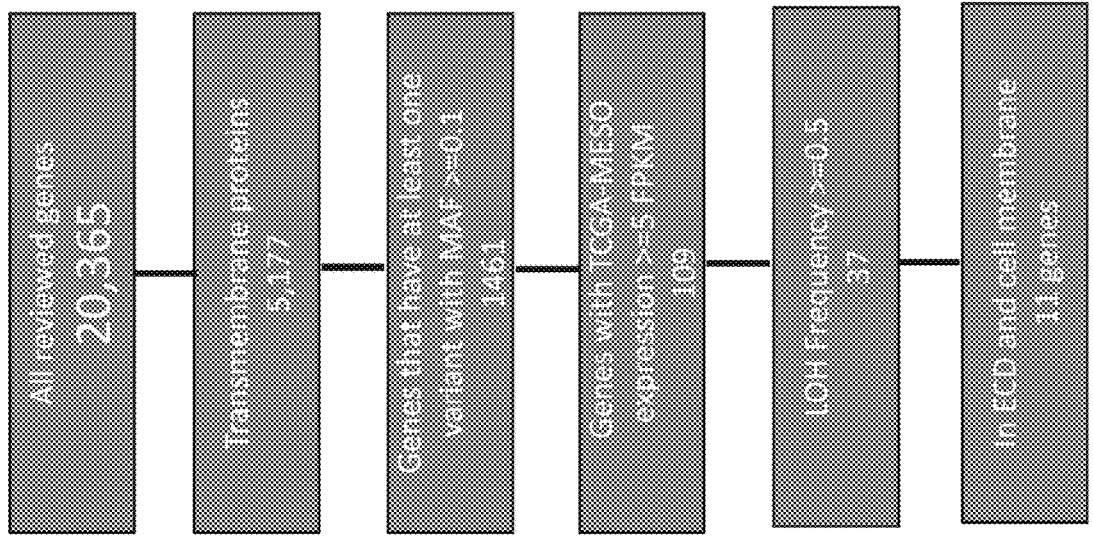
FIG. 13 is a diagram of the bioinformatics pipeline used to identify potential inhibitory receptor targets that are lost in cancer cells due to loss of heterozygosity.

Genes that passed the filters were checked for other variants in Ensembl Genome Browser or VEP analysis output, as well as the locations of the variations in the gene. 11 genes passed all filters. A summary of this process is shown in FIG. 13.

Candidate blocker targets ICAM1, COMT and CXCL16 were identified. As summary of the frequency of LOH in various cancers for ICAM1, COMT and CXCL16 is shown in Table 17 below.

TABLE 17

Frequency of LOH

| | LOH Freq | | |
|---|---|---|---|
| | ICAM1 | COMT | CXCL16 |
| Ovarian (all) | 0.33 | 0.64 | 0.74 |
| Pancreatic (all) | 0.15 | 0.25 | 0.48 |
| Mesothelioma (all) | 0.09 | 0.7 | 0.21 |
| Lung (3/4) | 0.46 | 0.3 | 0.58 |
| Colorectal (3/4) | 0.12 | 0.33 | 0.58 |
| Blood cancers | | | 0.1 |
| AML | | | 0.07 |
| variant | K/E | V/M | I/T |
| MAF | 0.36 | 0.37 | 0.46 |

TABLE 18

Summary of ICAM1, COMT and CXCL16 variants

| Gene Name | Variant | Protein Position | Change | MAF |
|---|---|---|---|---|
| CXCL16 | rs2277680, rs1050998 | 1. 200, 2. 142 | 1. A/V, 2. I/T | 1. 0.4615, 2. 0.4633 |
| COMT | rs4680 | 158 | V/M | 0.369 |
| ICAM1 | rs5498 | 469 | K/E | 0.359 |

Example 3: Identification of Blocker Ligand Binding Domains

Publicly available antibodies to candidate blocker antigens are sequenced, if CDR sequences are unknown. If no antibodies to candidate blocker targets are available, these antibodies are generated by immunization of mice, rats, or rabbits with purified protein (e.g., ICAM1, CXCL16, and COMT1). Sera from immunized animals is used to screen for mAbs for binding to blocker targets. Antibodies to blocker targets are also generated using the huTARG™ system. Antibodies with the desired specificity are then isolated and sequenced to determine CDR sequences.

CDR sequence from antibodies to blocker targets are used to generate scFv using standard molecular biology techniques. Candidate scFv are fused to inhibitor receptor hinge or transmembrane domains to generate inhibitory receptors using standard molecular biology techniques. Candidate scFv are also fused to activator receptor hinge or transmembrane domains (e.g., CAR) to generate full length activator receptors to use as a positive control for scFv binding to target antigens. The ability of candidate scFv to work in the context of an inhibitory receptor is assayed in Jurkat cells using the NFAT-luciferase reporter assay.

Example 4: HLA-A*02 Blocker can Block MSLN Activator Mediated Activation of Jurkat Cells Cell Culture Jurkat cells encoding an NFAT Luciferase reporter were obtained from BPS Bioscience. In culture, Jurkat cells were maintained in RPMI media supplemented with 10% FBS, 1% Pen/Strep and 0.4 mg/mL G418/Geneticin. All other cell lines used in this study were obtained from ATCC, and maintained as suggested by ATCC.

Jurkat Cell Transfection

Jurkat cells were transiently transfected via 100 uL format Neon electroporation system (Thermo Fisher Scientific) according to manufacturer's protocol using the following settings: 3 pulses, 1500V, 10 msec. Cotransfection was performed with 1-3 ug of activator CAR or TCR construct and 1-3 ug of blocker constructs or empty vector per 1e6 cells and recovered in RPMI media supplemented with 20% heat-inactivated FBS and 0.1% Pen/Strep.

Jurkat-NFAT-Luciferase Activation Studies

Jurkat cells were resuspended in 15 uL of RPMI supplemented with 10% heat-inactivated FBS and 0.1% Pen/Strep, added to the peptide-loaded beads and co-cultured for 6 hours. ONE-Step Luciferase Assay System (BPS Bioscience) was used to evaluate Jurkat luminescence. Assays were performed in technical duplicates.

Primary T Cell Transduction, Expansion, and Enrichment

Frozen PBMCs were thawed in 37° C. water bath and cultured at 1e6 cells/mL in LymphoONE (Takara) with 1% human serum and activated using 1:100 of T cell TransAct (Miltenyi) supplemented with IL-15 (10 ng/mL) and IL-21 (10 ng/mL). After 24 hours, lentivirus was added to PBMCs at a MOI of 5. PBMCs were cultured for 2-3 additional days to allow cells to expand under TransAct stimulation. Post expansion, activator and blocker transduced primary T cells were enriched using anti-PE microbeads (Miltenyi) according to manufacturer's instructions. Briefly, primary T cells were incubated with CD19-Fc (R&D Systems) at 1:100 dilution for 30 minutes at 4° C. in MACS buffer (0.5% BSA+2 mM EDTA in PBS). Cells were washed 3 times in MACS buffer and incubated in secondary antibody (1:200) for 30 minutes at 4° C. in MACS buffer. Cells were then incubated in anti-PE microbeads and passed through the LS column (Miltenyi).

Primary T Cell In Vitro Cytotoxicity Studies

For cytotoxicity studies with pMHC targets, enriched primary T cells were incubated with SiHa or HeLa cells expressing *Renilla* luciferase (Biosettia), and GFP or RFP. Live luciferase-expressing SiHa or HeLa cells were quantified using a *Renilla* Luciferase Reporter Assay System (Promega). Enriched primary T cells were incubated with SiHa or HeLa ("tumor" cells) or HLA-A*02 transduced SiHa or HeLa cells ("normal" cells). WT "tumor" SiHa or HeLa cells stably expressing GFP or RFP and *Renilla* luciferase (Biosettia) or HLA-A*02 "normal" SiHa or HeLa cells stably expressing RFP and luciferase (Biosettia) were imaged together with unlabeled primary T cells using an IncuCyte live cell imager.

Activation of Jurkat effector cells expressing an MSLN CAR activator and a pMHC HLA-A*02 scFv LIR-1 based inhibitory receptor was assayed using the NFAT Luciferase assay.

Jurkat cells were transfected with activator:blocker DNA at a ratio of 1:4, and activation was assayed in a cell-free bead based assay (FIG. 10A). Beads were loaded with either activator antigen, or activator and blocker antigens, and the ratio of beads to Jurkat cells was varied. In the cell-free bead based assay, the pMHC HLA-A*02 scFv LIR-1 based inhibitory receptor was able to block activation of the Jurkat cells when cells were contacted with beads carrying the pMHC HLA-A*02 blocker and MSLN activator in cis. Presence of the pMHC HLA-A*02 blocker on the beads was able to shift $E_{MAX}$ of MSLN CAR by greater than or equal to 12x (FIG. 10A).

Activation Jurkat cells transfected with the same activator and blocker at a 1:4 DNA ratio were assayed for activation using the chronic myelogenous leukemia cell line K562. K562 expresses MSLN, the activator antigen. The response of Jurkat effector cells to K562 cells transduced with HLA-A*02 to express both activator and blocker antigens (MSLN+HLA-A*02+) and untransduced K562 (MSLN+ HLA-A*02−) that expressed the activator but not the blocker antigen was assayed. As can be seen in FIG. 10B, expression of HLA-A*02+ by the K562 cells was able to shift the MSLN CAR $E_{MAX}$ by greater than 5X.

The ability of the pMHC HLA-A*02 inhibitory receptor to block activation via the MSNL scFv CAR was also assayed using effector primary T cells and SiHa or HeLa target cells. SiHa and HeLa cells endogenously express MSLN, and were transduced to express the HLA-A*02 inhibitory receptor target. Activation of primary effector T cells was assayed by looking at fold induction of IFNγ. As shown in FIG. 11, the pMHC HLA-A*02 LIR-1 inhibitory receptor was able to block activation of primary T cells when the primary T cells were presented with SiHa or HeLa target cells expressing HLA-A*02 (greater than 10x and 5x inhibition, respectively).

Figure 12:
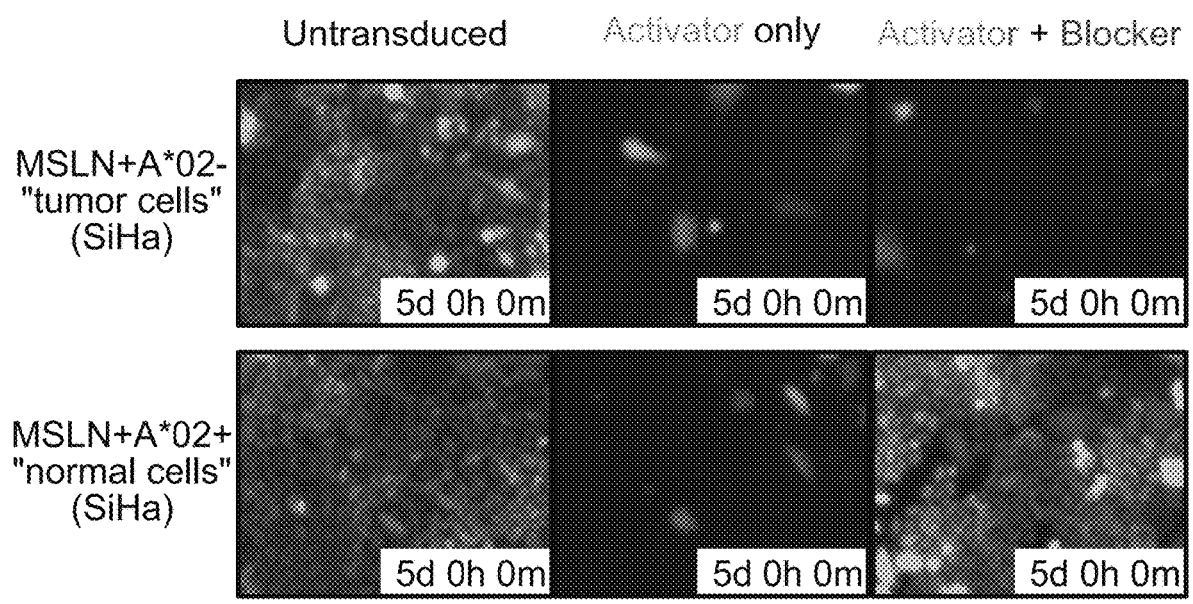
FIG. 12 shows that a pMHC HLA-A*02 scFv LIR-1 based inhibitory receptor inhibits killing by MSLN CAR activators using HLA-A*02+ SiHa cells but not HLA-A*02− SiHa cells.
Figure 12:
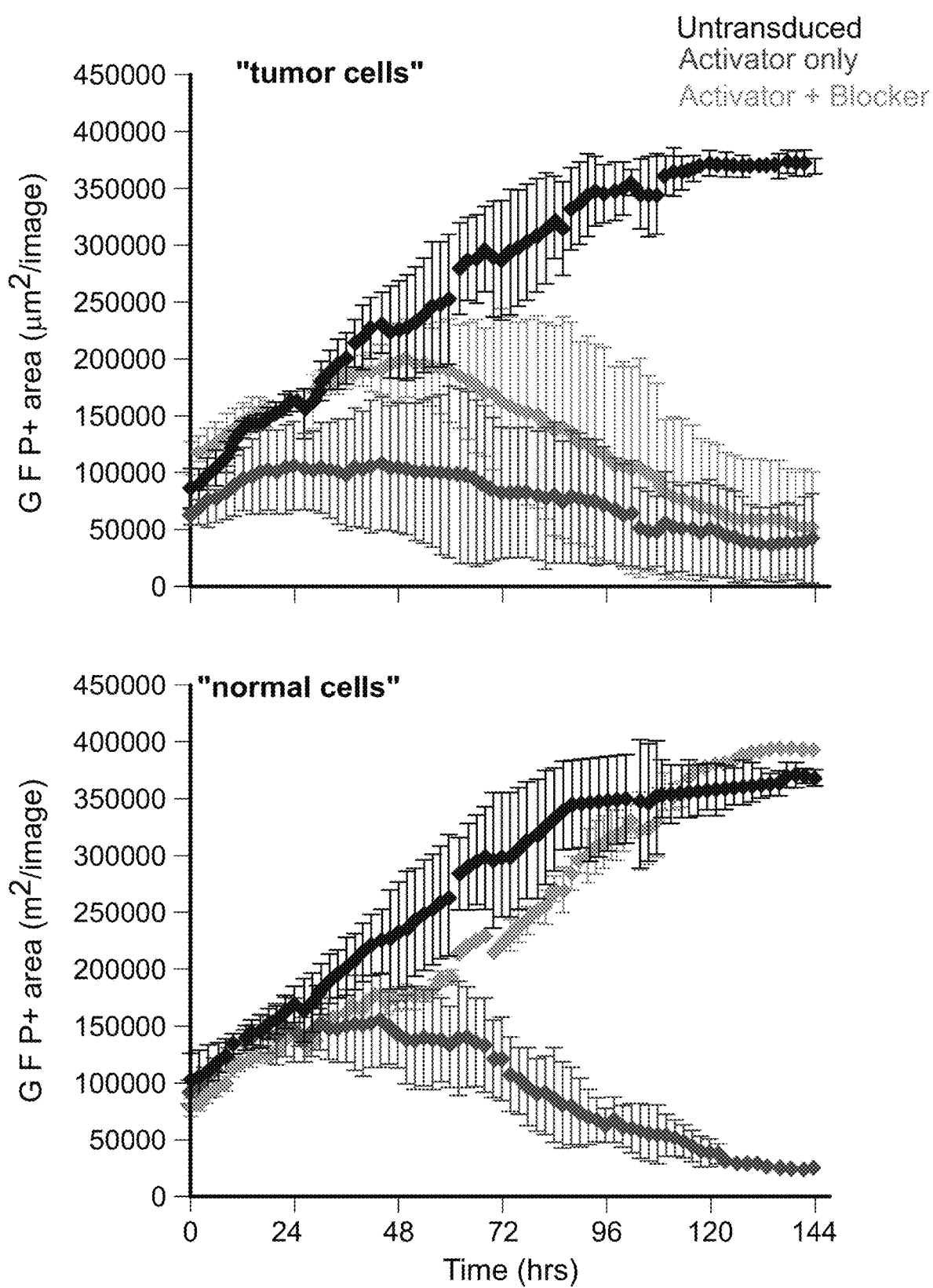

The pMHC HLA-A*02 inhibitory receptor was also able to inhibit killing by T cells expressing both the MSLN scFv CAR and the pMHC HLA-A*02 LIR-1 inhibitory receptor, when the T cells were presented with SiHa cells that expressed MSLN but not HLA-A*02 (FIG. 12).

Figure 15A:
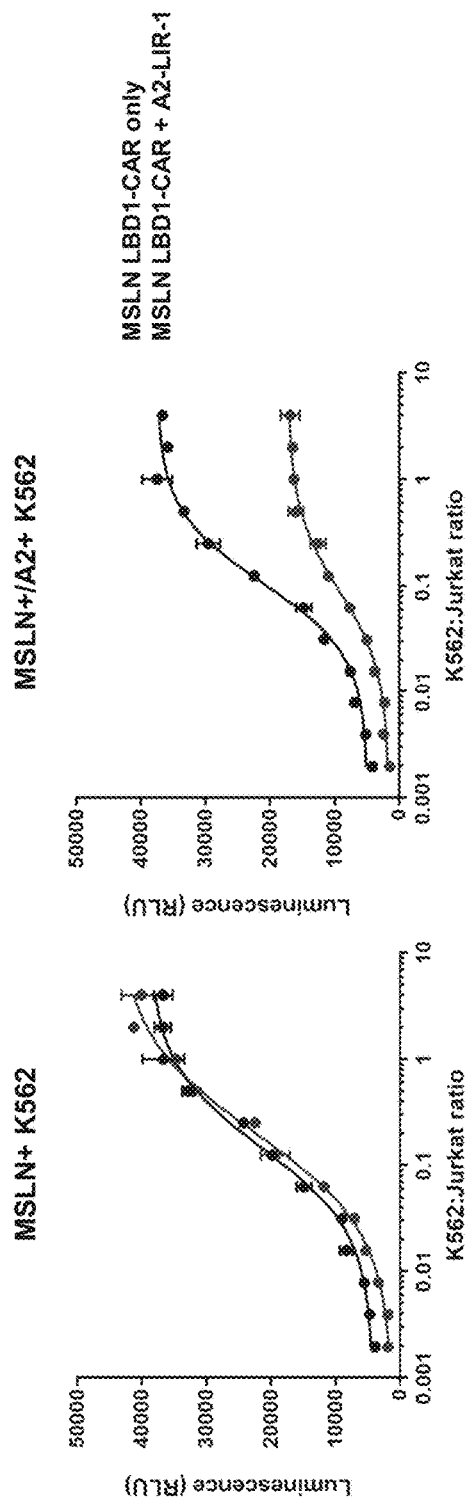
FIG. 15A is a pair of plots showing that the HLA-A*02 blocker inhibits MSLN CAR activators directed at MSLN, a high-density antigen. Jurkat cells transfected with MSLN LBD1-CAR or MSLN LBD1-CAR & A2-LIR-1 co-cultured with K562 cells expressing either MSLN or MSLN & HLA-A*02 shows blocking of activation by a high-density antigen with A2-LIR-1 blocker only in the presence of HLA-A*02.
Figure 15B:
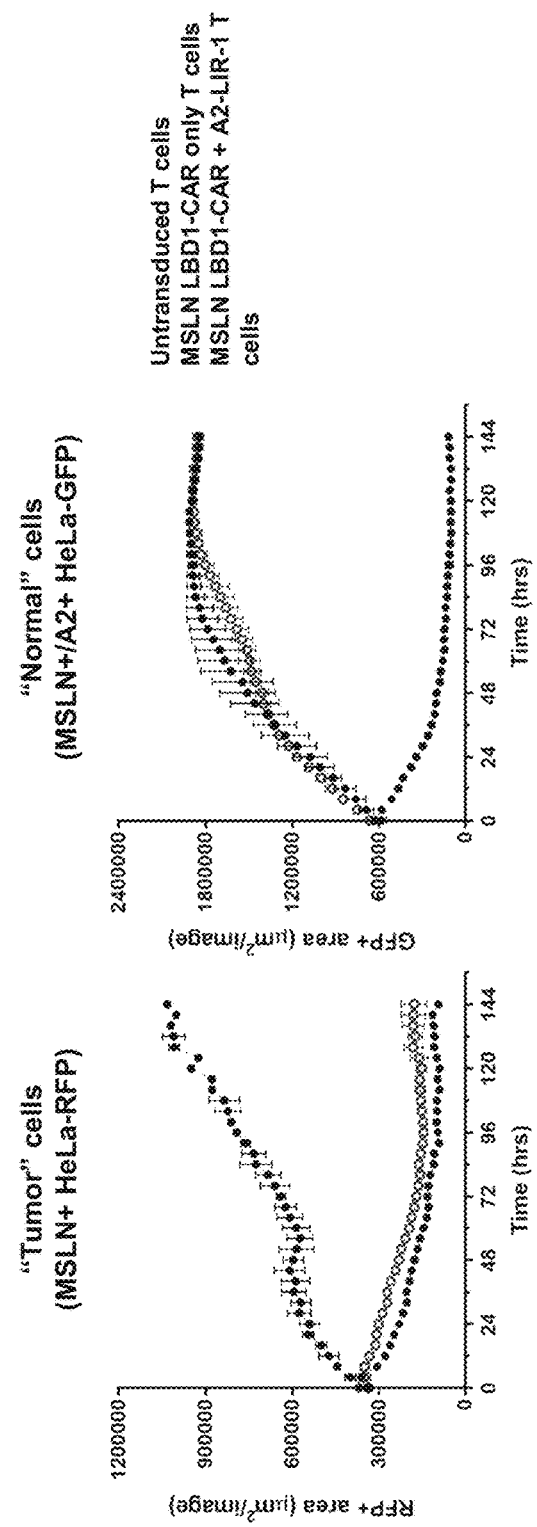
FIG. 15B is a pair of plots showing that the HLA-A*02 blocker inhibits MSLN CAR activators directed at MSLN, a high-density antigen. Killing of endogenous MSLN+ HeLa cells by MSLN LBD1-CAR T cells is blocked in the presence of HLA-A*02 with the A2-LIR-1 blocker.
Figure 15C:
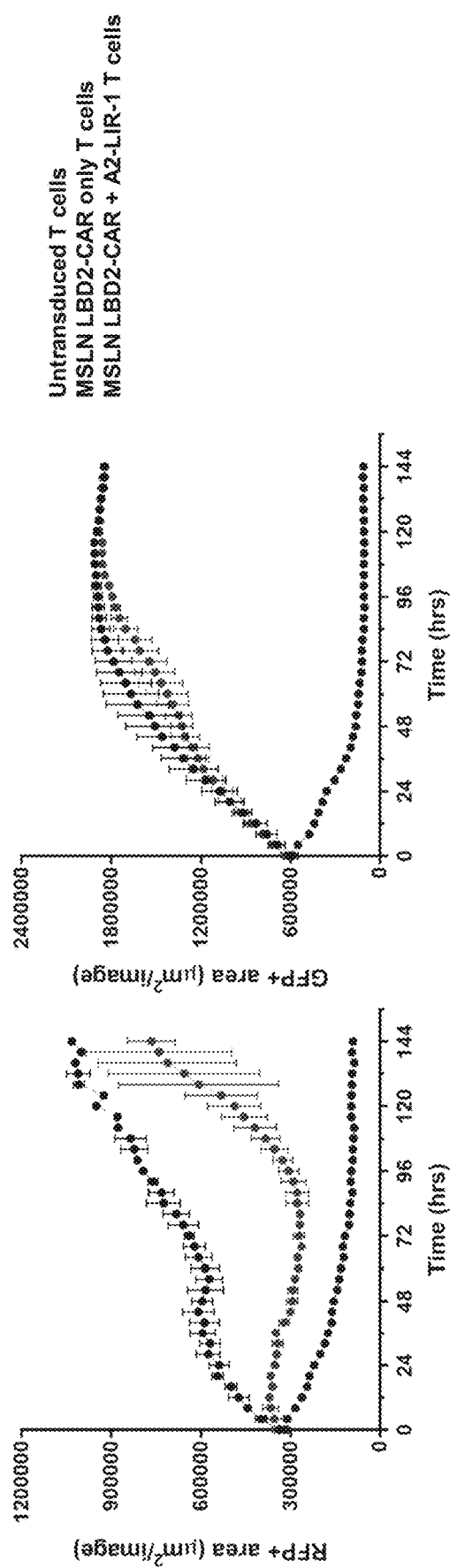
FIG. 15C is a pair of plots showing that the HLA-A*02 blocker inhibits MSLN CAR activators directed at MSLN, a high-density antigen. Killing of endogenous MSLN+ HeLa cells by MSLN LBD2-CAR T cells is shown. The effect of A2-LIR-1 blocker on T cell killing is in part controlled by the activator LBD, suggesting further optimization of the blocker module or pairs of activator/blockers may be required.

Example 5: HLA-A*02 Blocker Inhibits MSLN CAR Activators Directed at MSLN Using K562 and HeLa Target Cells Cell Culture MSLN CAR activator and HLA-A02 LIR-1 inhibitory receptor were examined, using Jurkat effector cells and K562 target cells (FIG. 15A). The ability of MSLN CART cells expressing MSLN CAR (with two different MSLN ligand binding domains) to kill HeLa cells expressing the blocker target, HLA-A*02, was also assayed (FIGS. 15B-15C). The MSLN ligand represents surface antigens that can extend into the realm of 100,000 epitopes/cell. The ratio of A to B module expression was varied using different DNA concentrations in transient transfection assays. The activator and inhibitory receptor system is flexible enough to accommodate low and high target densities, in principle allowing optimization for pMHC targets as well as non-pMHC surface antigens.

Jurkat cells encoding an NFAT luciferase reporter were obtained from BPS Bioscience. All other cell lines used in this study were obtained from ATCC. In culture, Jurkat cells were maintained in RPMI media supplemented with 10% FBS, 1% Pen/Strep and 0.4 mg/mL G418/Geneticin. K562 and HeLa cells were maintained as suggested by ATCC.

MSLN Antigen Binding Domains

MSLN-activating CAR scFv were derived from human M5 (LBD1) as described Beatty, et al. WO2015/090230A1 and humanized SS1 (LBD2) as described in BioLuminate, 2019 (BioLuminate, version 3.6, version 3.6 ed. Schrödinger, LLC, New York, N.Y.) and U.S. Pat. No. 6,809,184 B1.

Jurkat Cell Transfection and Activation

Jurkat cells were transiently transfected via 100 uL format Neon electroporation system (Thermo Fisher Scientific) according to manufacturer's protocol using the following settings: 3 pulses, 1500V, 10 msec. Co-transfection was performed with 1-3 ug of activator construct and 1-3 ug of blocker constructs or empty vector per 1e6 cells and recovered in RPMI media supplemented with 20% heat-inactivated FBS and 0.1% Pen/Strep. To confirm blocker surface expression, Jurkat cells were stained 18-24 hours post-transfection with 10 ug/mL streptavidin-PE-HLA-A*02−pMHC tetramer for 60 minutes at 4° C. in PBS with 1% BSA and characterized by flow cytometry (BD FACS Canto II).

Jurkat cell activation was evaluated using the NFAT-luciferase assay system as described in Example 4.

Primary T Cell Transduction, Expansion, and Enrichment

Leukopaks were purchased from AllCells®. Collection protocols and donor informed consent were approved by an Institutional Review Board (IRB), with strict oversight. HIPAA compliance and approved protocols were also followed. Frozen PBMCs were thawed and cultured as described in Example 4. Cells were simultaneously co-transduced at a MOI=5 for each lentivirus, i.e. lentiviral vectors including activator or blocker receptor. PBMCs were cultured for 2-3 additional days to allow cells to expand under TransAct stimulation. Post expansion, activator and blocker transduced primary T cells were enriched for blocker-positive T cells by positive selection using anti-PE microbeads (Miltenyi) according to manufacturer's instructions. Briefly, primary T cells were incubated with 10 ug/mL streptavidin-PE-HLA-A*02- pMHC tetramer for 60 minutes at 4° C. in MACS buffer (0.5% BSA+2 mM EDTA in PBS). Cells were washed 3 times in MACS buffer and passed through the LS column (Miltenyi) to separate blocker-positive cells (a mix of blocker-only and activator+ blocker cells) from untransduced and activator-only cells.

Primary T Cell In Vitro Cytotoxicity Studies

For cytotoxicity studies with pMHC targets, enriched primary T cells were incubated with K562 or HeLa target cells expressing *Renilla* luciferase (Biosettia). Target cells that were HLA-A*02 positive also expressed GFP and firefly luciferase (Biosettia), and target cells that were HLA-A*02 negative expressed RFP and firefly luciferase. Target cells were imaged together with unlabeled primary T cells using an IncuCyte live cell imager. Fluorescence intensity of live target cells over time was quantified using IncuCyte imaging software.

Example 6: Mouse SS1 MSLN Antigen Binding Domain Activator in 2$^{nd}$ and 3$^{rd}$ Generation CAR Architectures and HLA-A*02 Blocker Originally, humanized M5 and SS1 scFv targeting MSLN were used with a third generation CAR architecture (CD28, 4-1BB and CD3 zeta). The effect of using a murine SS1 scFv antigen binding domain, and second generation CAR architecture (4-1BB and CD3zeta intracellular domains) was assayed.

Figure 16:
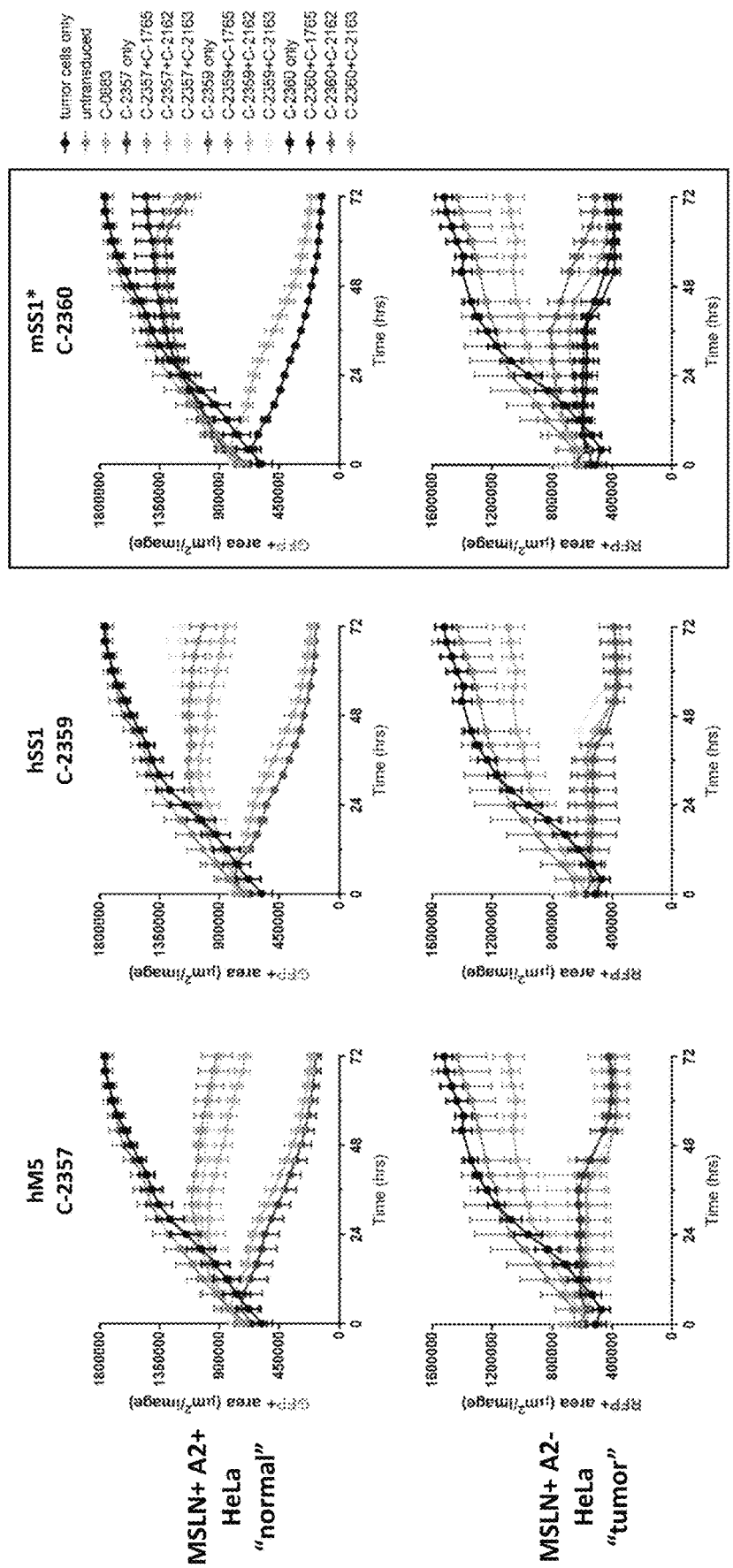
FIG. 16 is a series of plots showing that HLA-A*02 LIR1 inhibitory receptors (PA2.1, mouse and humanized) effectively block killing by T cells expressing MSLN Generation 3 CAR in the presence of HeLa cells that express MSLN and HLA-A*02. Top row: MSLN+HLA-A*02+ HeLa target cells; bottom row: MSLN+HLA-A*02− HeLa cells (control). The murine SS1 generation 3 CAR (upper right, boxed) provides a better window than the humanized M5 and humanized SS1 CARs.

HLA-A*02- donor T cells were transduced with MSLN third generation CAR activator (a CAR with CD28, 4-1BB and CD3 zeta intracellular domains) and an HLA-A*02 scFv LIR-1 blocker using a PA2.1 antigen binding domain. MSLN CAR activators with humanized M5, humanized SS1 and murine SS1 scFv were assayed (Table 1). HLA-A*02 blocker sequences are described in Table 5. T cells were transduced with activator and/or blocker constructs, cultured, and enriched as described in Examples 4 and 5. T cells were used on day 14 following transduction, and were cultured with MSLN+ HeLa target cells at an effector: target ratio of 1:1. Cytotoxicity was assayed as described in Examples 4 and 5. FIG. 16 shows that inhibitor receptors were able to effectively block killing of HeLa cells by T cells expressing the MSLN third generation CAR when the HeLa cells also expressed HLA-A*02. Further, FIG. 16 shows that the murine SS1 generation 3 CAR (upper right plot, boxed) provides a better window than the humanized M5 and humanized SS1 CARs. Note, in FIG. 16, C-0883 is an HLA-A*02 CAR used as a positive control, additional sequences are described in Table 19.

Figure 17:
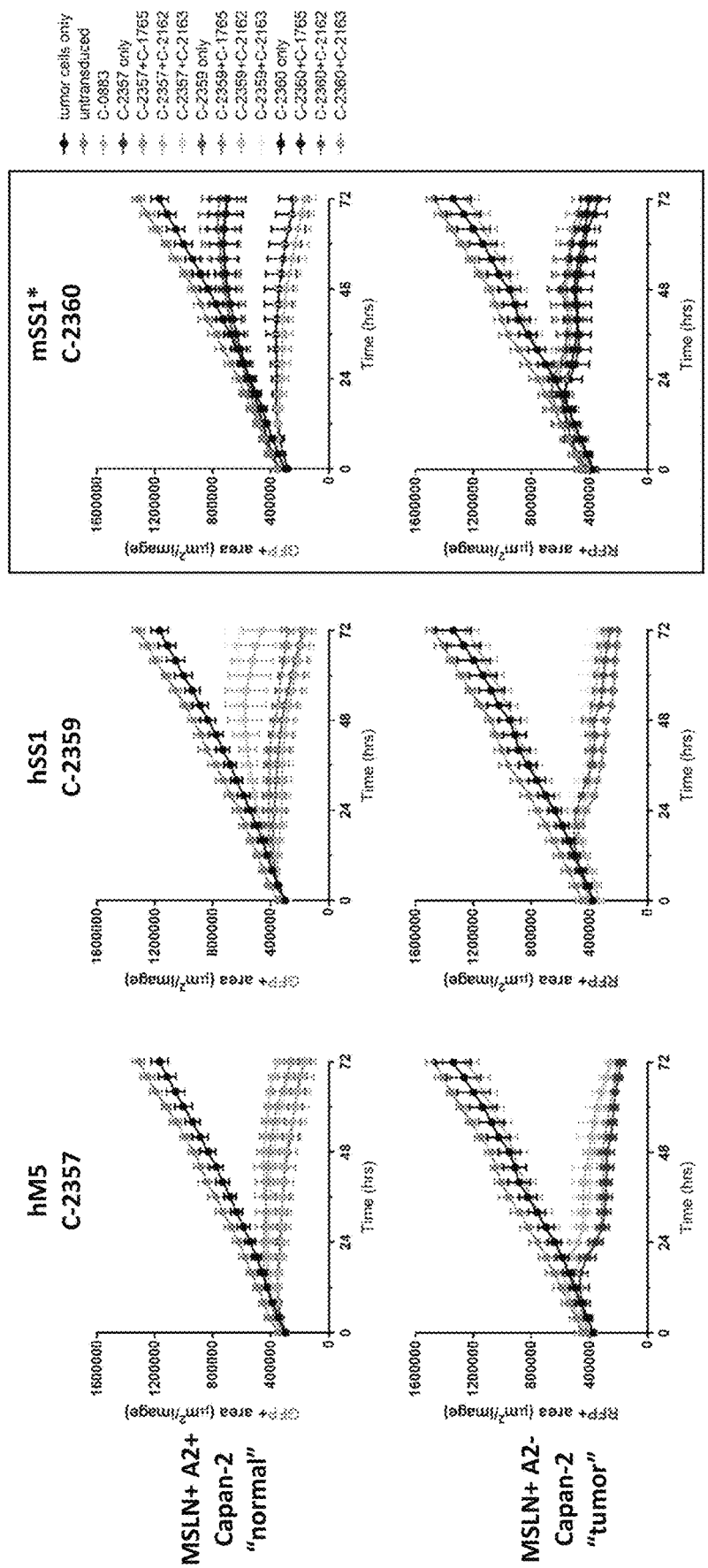
FIG. 17 is a series of plots showing that HLA-A*02 LIR1 inhibitory receptors (PA2.1, mouse and humanized) effectively block killing by T cells expressing MSLN Generation 3 CAR in the presence of MSLN+HLA-A*02+ Capan-2 cells.

The ability of T cells expressing the MSLN activator and HLA-A*02 LIR1 blocker to selectively kill MSLN+HLA-A*02- Capan cells was also assayed (FIG. 17). T cells were transduced with activator and/or blocker receptor constructs, cultured, and enriched as described in Examples 4 and 5. T cells were used on day 14 following transduction, and were cultured with Capan target cells at an effector: target ratio of 1:1. Cytotoxicity was assayed as described in Examples 4 and 5. FIG. 17 shows that inhibitor receptors were able to effectively block killing of Capan cells by T cells expressing the MSLN third generation CAR when the Capan cells also expressed HLA-A*02.

Figure 18:
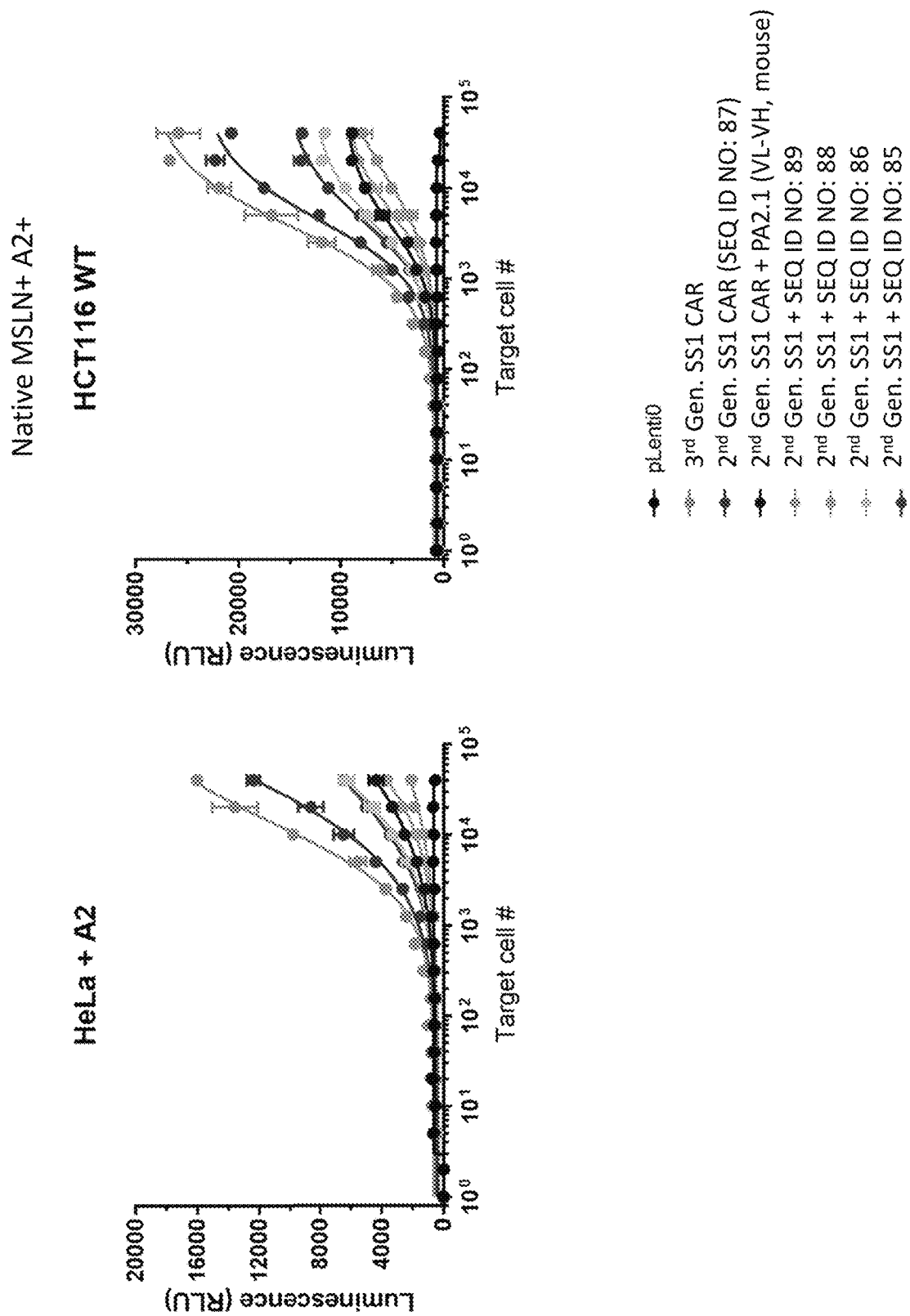
FIG. 18 is a pair of plots that shows that killing of MSLN+HLA-A*02+ HeLa cells (left) or HCT116 wild type (WT) cells that are natively MSLN+HLA-A*02+ by T cells expressing a 2nd generation CAR with a murine SS1 scFv is effectively blocked by an HLA-A*02 scFv LIR1 inhibitory receptor.

The murine SS1 MSLN1 scFv was also assayed in a generation 2 CAR (a CAR with a 4-1BB and CD3 zeta intracellular domain). FIG. 18 shows that killing of MSLN+ HLA-A*02+ HeLa cells, and HCT116 wild type cells (which natively express both MSLN and HLA-A*02) by T cells expressing the mSS1 2$^{nd}$ generation CAR was effectively blocked by HLA-A*02 scFv LIR-1 inhibitory receptor. As can be seen from FIG. 18, the 2$^{nd}$ generation mSS1 CAR was more effectively blocked by inhibitory receptors with a PA2.1 scFv antigen binding domain than by inhibitory receptors with a BB7.2 scFv antigen binding domain. The effect of short and long LIR-1 hinge sequences in the inhibitory receptor, and the arrangement of the VH and VL domains in the HLA-A*02 scFv, was also assayed.

Figure 19:
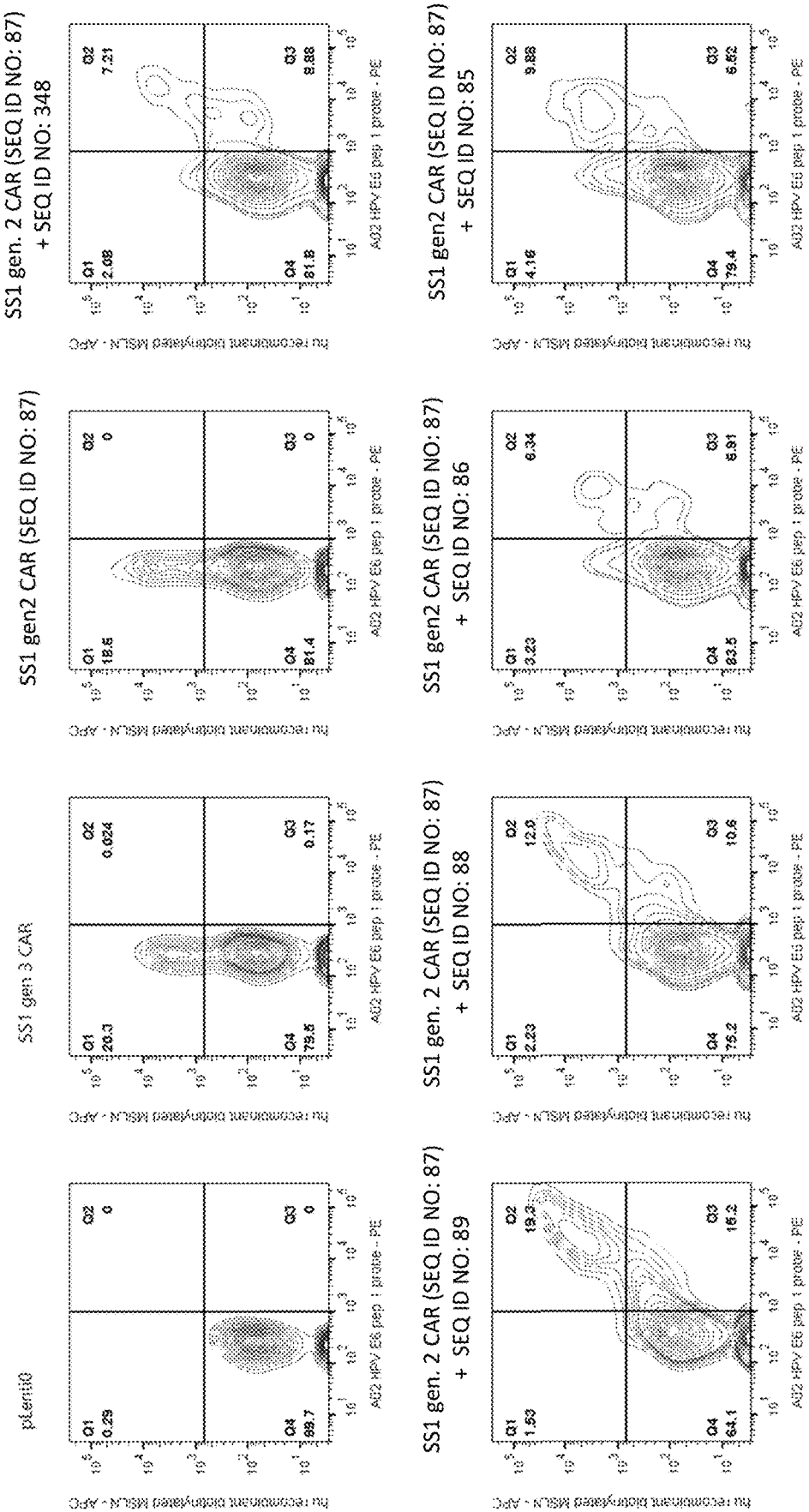
FIG. 19 is a series of fluorescence activated cell sorting (FACS) plots showing the expression of murine SS1 second generation CARs by T cells, with and without co-transduction of an HLA-A*02 scFv LIR-1 blocker.

Expression of the 2nd generation CAR with the murine SS1 scFv was also confirmed via FACS, and the results are shown in FIG. 19. The SS1 antigen binding domain was stained using a recombinant soluble MSLN ligand.

TABLE 19

Sequences of constructs

| Name | Amino Acid Sequence | Nucleotide Sequence |
|---|---|---|
| PA2.1.14 (VL:VH) scFv LIRI sHTICD | TEFTLTISSLQPDDFATYYCFQGSHVPRTFGQGTKV EVKGGGGSGGGGSGGGGSGGQVQLVQSGAEVKKPGS SVKVSOKASGYTFTSYH1HWVRQAPGQGLEWIGWIY PGNVNTEYNEKFKGKATITADESTNTAYMELSSLRS EDTAVYYCAREEITYAMDYWGQGTLVTVSSVVSGPS GGPSSPTTGPTSTSGPEDQPLTPTGSDPQSGLGRHL GWIGILVAVILLLLLLLLLFLILRHRRQGKHWTST QRKADFQHPAGAVGPEPTDRGLQWRSSPAADAQEEN LYAAVKHTQPEDGVEMDTRSPHDEDPQAVTYAEVKH SRPRREMASPPSPLSGEFLDTKDRQAEEDRQMDTEA AASEAPQDVTYAQLHSLTLRREATEPPPSQEGPSPA VPSIYATLAIH (SEQ ID NO: 85) | (SEQ ID NO: 1252) |

TABLE 19-continued

Sequences of constructs

| Name | Amino Acid Sequence | Nucleotide Sequence |
|---|---|---|
| PA2.1.14 (VL:VH) scFv LIR1 HTICD | DIQMTQSPSTLSASVGDRVTITCRSSQSIVHSNGNT YLEWYQQKPGKAPKLLIYKVSNRFSGVPARFSGSGS GTEFTLTISSLQPDDFATYYCFQGSHVPRTFGQGTK VEVKGGGGSGGGGSGGGGSGGQVQLVQSGAEVKKPG SSVKVSCKASGYTFTSYHIHWVRQAPGQGLEWIGWI YPGNVNTEYNEKFKGKATITADESTNTAYMELSSLR SEDTAVYYCAREEITYAMDYWGQGTLVTVSSYGSQS SKPYLLTHPSDPLELVVSGPSGGPSSPTTGPTSTSG PEDQPLTPTGSDPQSGLGRHLGVVIGILVAVILLLL LLLLLFLILRHRRQGKHWTSTQRKADFQHPAGAVGP EPTDRGLQWRSSPAADAQEENLYAAVKHTQPEDGVE MDTRSPHDEDPQAVTYAEVKHSRPRREMASPPSPLS GEFLDTKDRQAEEDRQMDTEAAASEAPQDVTYAQLH SLTLRREATEPPPSQEGPSPAVPSIYATLAIH (SEQ ID NO: 86) | (SEQ ID NO: 1253) |
| MSLN_SsI CD8HT 41BB CD3z | QVQLQQSGPELEKPGASVKISCKASGYSFTGYTMNW VKQSHGKSLEWIGLITPYNGASSYNQKFRGKATLTV DKSSSTAYMDLLSLTSEDSAVYFCARGGYDGRGFDY WGQGTTVTVSSGGGGSGGGGSGGGGSDIELTQSPAI MSASPGEKVTMTCSASSSVSYMHWYQQKSGTSPKRW IYDTSKLASGVPGRFSGSGSGNSYSLTISSVEAEDD ATYYCQQWSGYPLTFGAGTKLEITTTPAPRPPTPAP TIASQPLSLRPEACRPAAGGAVHTRGLDFACDIYIW APLAGTCGVLLLSLVITLYCKRGRKKLLYIFKQPFM RPVQTTQEEDGCSCRFPEEEEGGCELRVKFSRSADA PAYKQGQNQLYNELNLGRREEYDVLDKRRGRDPEMG GKPRRKNPQEGLYNELQKDKMAEAYSEIGMKGERRR GKGHDGLYQGLSTATKDTYDALHMQALPPR (SEQ ID NO: 87) | (SEQ ID NO: 1254) |
| PA2.1.14 scFv LIR1 sHTICD | QVQLVQSGAEVKKPGSSVKVSCKASGYTFTSYHIHW VRQAPGQGLEWIGWIYPGNVNTEYNEKFKGKATITA DESTNTAYMELSSLRSEDTAVYYCAREEITYAMDYW GQGTLVTVSSGGGGSGGGGSGGGGSGGDIQMTQSPS TLSASVGDRVTITCRSSQSIVHSNGNTYLEWYQQKP GKAPKLLIYKVSNRFSGVPARFSGSGSGTEFTLTIS SLQPDDFATYYCFQGSHVPRTFGQGTKVEVKVVSGP SGGPSSPTTGPTSTSGPEDQPLTPTGSDPQSGLGRH LGWIGILVAVILLLLLLLLLFLILRHRRQGKHWTS TQRKADFQHPAGAVGPEPTDRGLQWRSSPAADAQEE NLYAAVKHTQPEDGVEMDTRSPHDEDPQAVTYAEVK HSRPRREMASPPSPLSGEFLDTKDRQAEEDRQMDTE AAASEAPQDVTYAQLHSLTLRREATEPPPSQEGPSP AVPSIYATLAIH (SEQ ID NO: 88) | (SEQ ID NO: 1255) |
| PA2.1.14 scFv LIR1 HTICD | QVQLVQSGAEVKKPGSSVKVSCKASGYTFTSYHIHW VRQAPGQGLEWIGWIYPGNVNTEYNEKFKGKATITA DESTNTAYMELSSLRSEDTAVYYCAREEITYAMDYW GQGTLVTVSSGGGGSGGGGSGGGGSGGDIQMTQSPS TLSASVGDRVTITCRSSQSIVHSNGNTYLEWYQQKP GKAPKLLIYKVSNRFSGVPARFSGSGSGTEFTLTIS SLQPDDFATYYCFQGSHVPRTFGQGTKVEVKYGSQS SKPYLLTHPSDPLELVVSGPSGGPSSPTTGPTSTSG PEDQPLTPTGSDPQSGLGRHLGVVIGILVAVILLLL LLLLLFLILRHRRQGKHWTSTQRKADFQHPAGAVGP EPTDRGLQWRSSPAADAQEENLYAAVKHTQPEDGVE MDTRSPHDEDPQAVTYAEVKHSRPRREMASPPSPLS GEFLDTKDRQAEEDRQMDTEAAASEAPQDVTYAQLH SLTLRREATEPPPSQEGPSPAVPSIYATLAIH (SEQ ID NO: 89) | (SEQ ID NO: 258) |

Example 7: Assaying the Effect of the LIR-1 Hinge on Blocking Activity

Figure 20A:
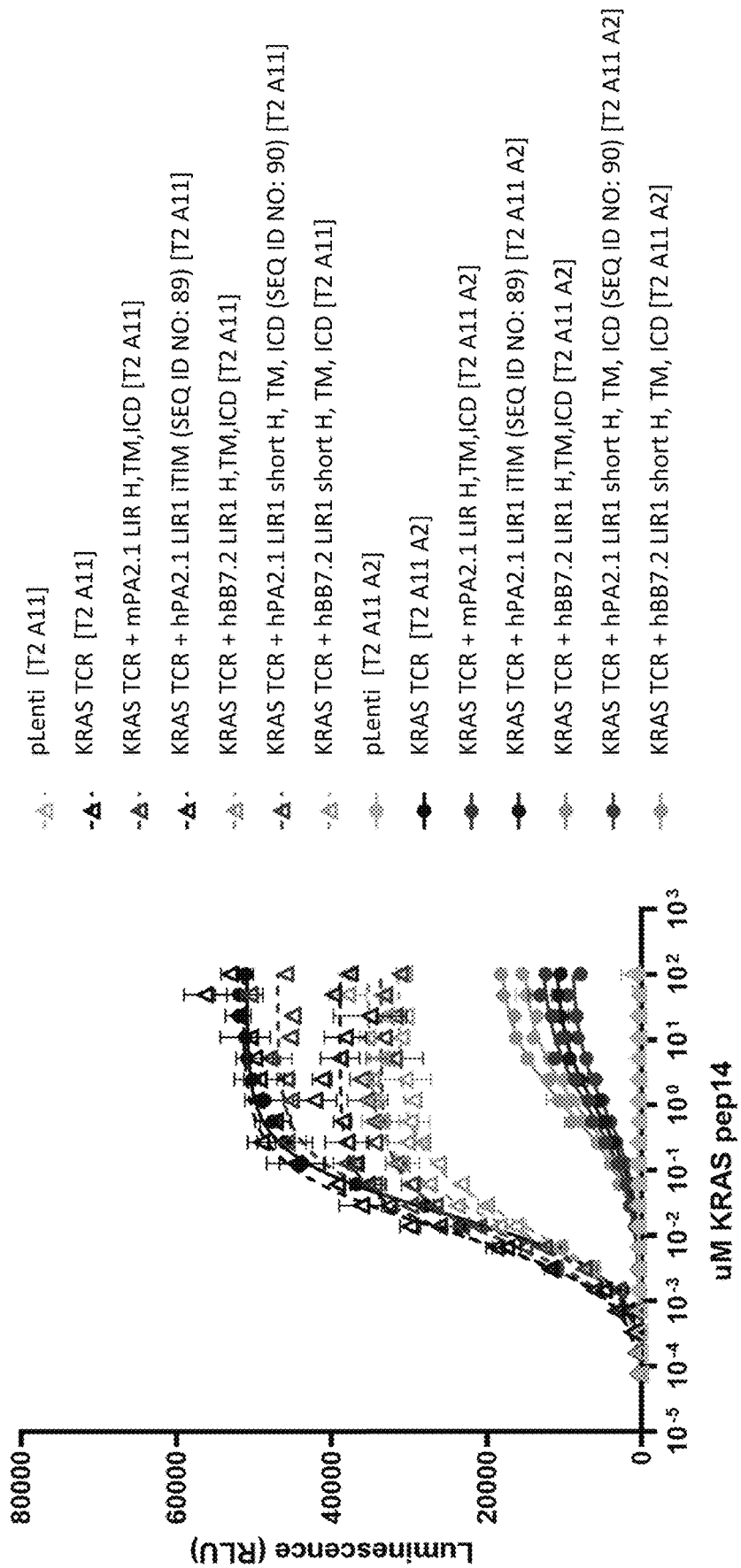
FIG. 20A is a plot showing the effect of LIR-1 hinge on the ability of an HLA-A*02 inhibitory receptor to block activation of Jurkat cells by a KRAS TCR. H: hinge, T: transmembrane domain, ICD: intracellular domain, s: short. LIR-1 constructs are described in more detail in FIG. 20B. Humanized PA2.1 and humanized BB7.2 with shorter LIR-1 hinge block similarly to original, longer hinge
Figure 20B:
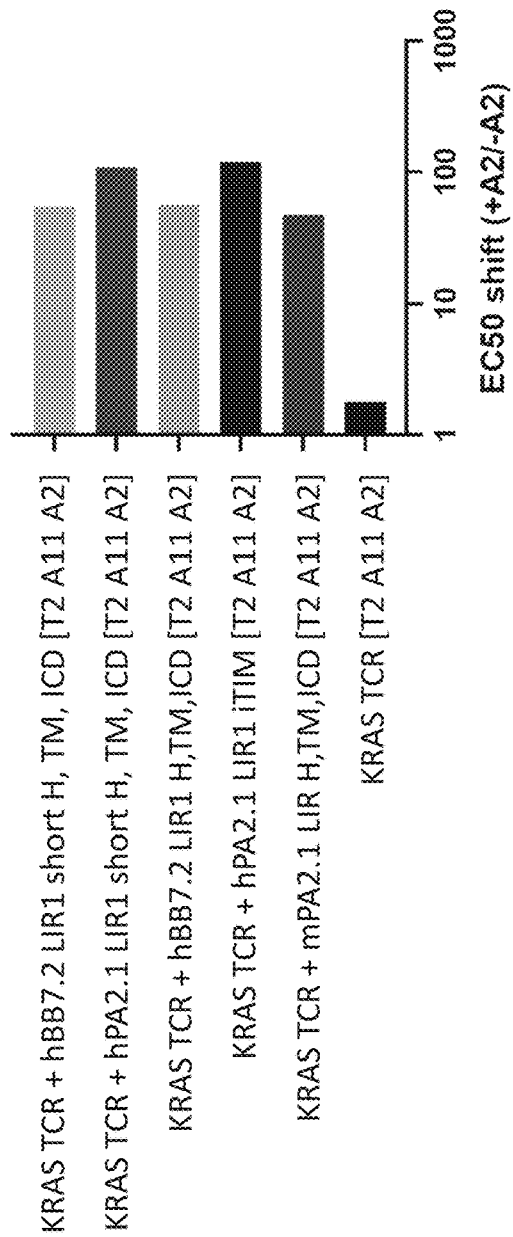
FIG. 20B is a plot and a table showing EC50 shift (+/−HLA-A*02 target cells) for Jurkat cells expressing a KRAS TCR activator and the HLA-A*02 scFv LIR-1 inhibitory receptors shown in the table at bottom (SEQ ID NOs: 352-356).

The effects of different LIR-1 hinges on the ability of HLA-A*02 scFv LIR-1 inhibitory receptors to block killing by Jurkat cells expressing a KRAS TCR activator was assayed using the Jurkat NFat Luciferase assays described supra. A humanized PA2.1 scFv LIR-1 receptor and humanized BB7.2 scFv LIR-1 with a shorter LIR-1 hinge were assayed in Jurkat cells as previously described, and the results are shown in FIGS. 20A-20B. Jurkat cells were transfected with a KRAS TCR activator receptor and/or HLA-A*02 scFv LIR-1 inhibitory receptor (humanized PA2.1 or humanized BB7.2) with a variety of LIR-1 derived hinges, methods as described supra, and co-cultured with T2 target cells that were either HLA-All positive, or HA-All and HLA-A*02 positive. Inhibitory receptors with both the shorter and longer hinge behaved similarly (FIG. 20A-B).

Figure 21B:
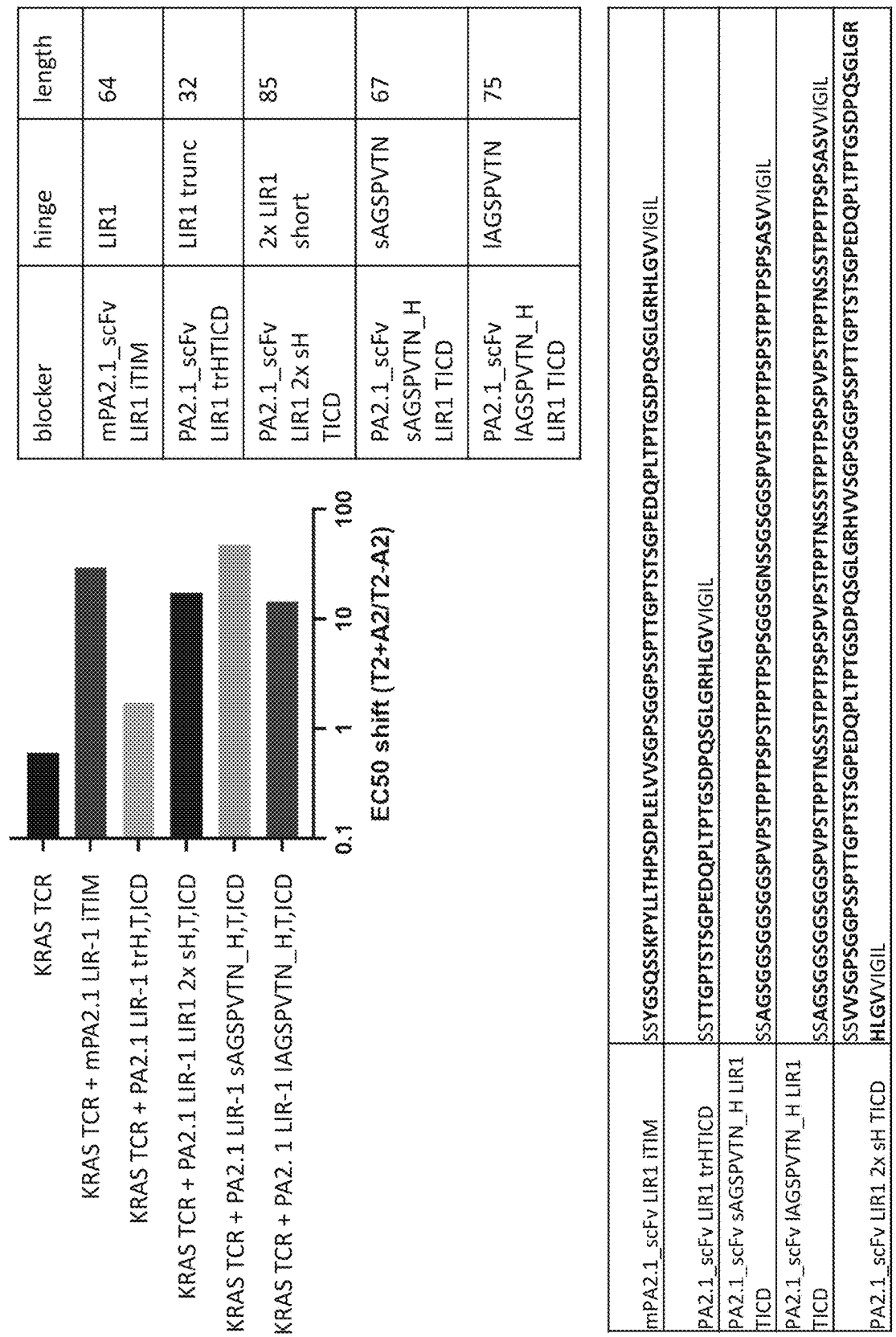
FIG. 21B is a plot and a pair of tables showing EC50 shift (+/−HLA-A*02 target cells) for Jurkat cells expressing a KRAS TCR activator and the HLA-A*02 scFv LIR-1 inhibitory receptors shown in the table at bottom (SEQ ID NOs: 357-361), with lengths shown in the table at left.

An inhibitory receptor with a mouse PA2.1 scFv and slightly longer hinges was also assayed functioned similarly to shorter LIR-1 hinges in the T2-Jurkat assay (FIG. 21A-B). Hinge sequences are shown in black in FIG. 20B and FIG. 21B, with the gray SS representing a linker between the antigen binding domain and the hinge, and the gray VIGIL the start of the LIR-1 transmembrane domain. Hinge, transmembrane domain and intracellular domain of the inhibitory receptors were all derived from LIR-1. FIGS. 20A-20B and 21A-21B show that LIR-1 hinge length can be varied without negatively effecting the LIR-1 inhibitory receptor. Shorter hinges can provide an advantage when packaging nucleic acid sequences encoding LIR-1 inhibitory receptors in lentiviral vectors for delivery.

Example 8: Identification of New Anti-MSLN Antibodies

Mesothelin (MSLN) is a classic tumor-associated antigen that is expressed in lung cancer and many other solid tumors. However, MSLN is also expressed in normal mesothelium that surrounds and lubricates the surfaces of key internal organs. This normal expression creates significant risk of serious inflammation for MSLN-directed therapeutics. This example describes a dual-receptor (Tmod) system which exploits common LOH at the HLA locus in cancer cells, allowing T cells to recognize the difference between tumor and normal tissue. T cells engineered with the MSLN CAR Tmod construct described in this example contain: (i) a MSLN-activated CAR; and, (ii) an inhibitory receptor gated by HLA-A*02. Without wishing to be bound by theory, the Tmod system robustly protects "normal" cells even in mixed-cell populations in vitro and in a xenograft model. The MSLN CAR can also be paired with other HLA class I blockers, supporting extension of the approach to patients beyond HLA-A*02 heterozygotes. The Tmod mechanism exemplified by the MSLN CAR Tmod construct may provide an alternative route to leverage solid-tumor antigens such as MSLN in safer, more effective ways than previously possible. Mesothelin (MSLN) was proposed as a cancer target in 1992 [1], yet there is still no viable therapy that utilizes MSLN. Not only is it expressed on most mesotheliomas but also large subsets of ovarian, cervical, uterine, gastric, pancreatic and lung adenocarcinomas [2]. In normal adults, MSLN is present only in mesothelium, a tissue that itself may be nonessential [2,3]. However, immunotherapy targeting MSLN carries the risk of inflammatory attack on MSLN(+) mesothelial cells that surround important internal organs [4]. Several investigational therapeutics directed at MSLN have been tested; for example, immunotoxin-conjugates [5, 6], antibody-drug conjugates [7], bispecific antibodies [8], CAR-Ts [9], and a hybrid TCR-scFv [10]. All active systemically administered therapeutics so far have been toxic. Recently, an approach to deliver MSLN CAR-Ts via intrapleural infusion has been reported [11].

Figure 22A:
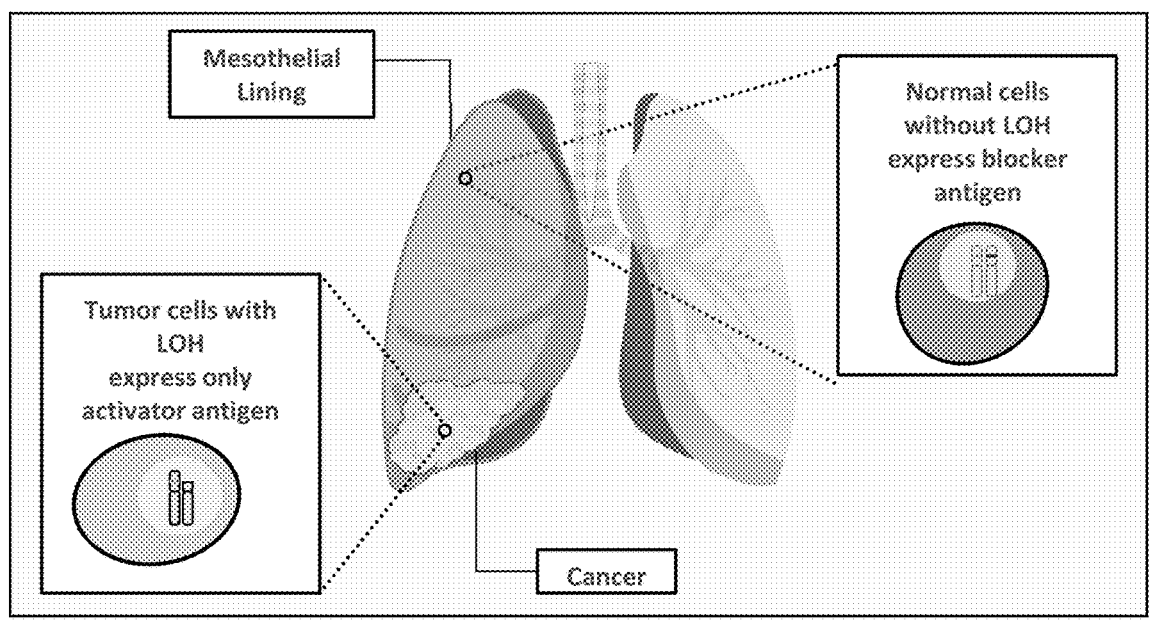
FIG. 22A and FIG. 22B show the Tmod approach to achieve selective cytotoxicity with two targets (Tmod refers to immune cells expressing the combination of activator and inhibitory receptor).
Figure 22B:
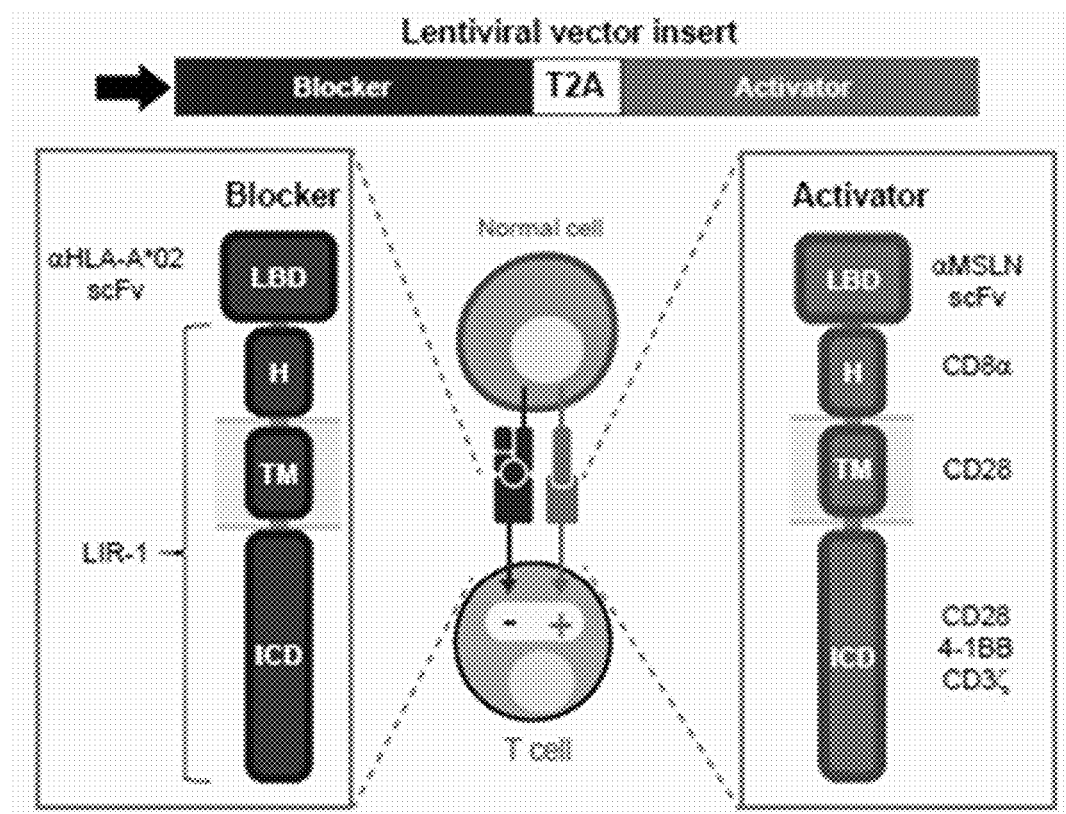

This example describes an exemplary method to treat MSLN(+) cancers that does not depend on local administration of therapeutics, but instead exploits LOH. This approach seeks to avoid systemic toxicity to normal tissues by pairing a MSLN-targeted CAR with a LIR-1-based inhibitory receptor that blocks effector function against normal cells that express the HLA-A*02 allele (FIG. 22A-22B). This dual-receptor construct is intended to treat genetically defined cancer patients who have LOH of the HLA-A*02 allele in their MSLN(+) tumor. The difference in HLA-A*02 expression in tumor vs. normal tissues caused by LOH creates an all-or-nothing input to the effector cells that is believed to confer high selectivity for tumor killing.

Results

Isolation and Characterization of Potent, Selective MSLN CARs

Figure 23A:
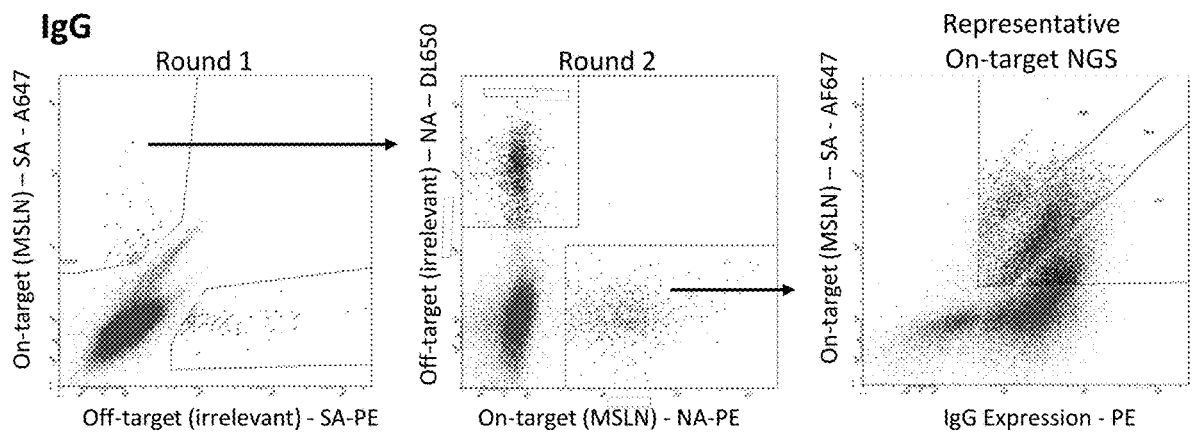
FIG. 23A, FIG. 23B, FIG. 23C, and FIG. 23D show the isolation and characterization of selective MSLN binders. On-target probe was labeled soluble MSLN (Acro Bio); off-target probe used for counterselection was a mixture of soluble CEA and EGFR proteins.
Figure 23B:
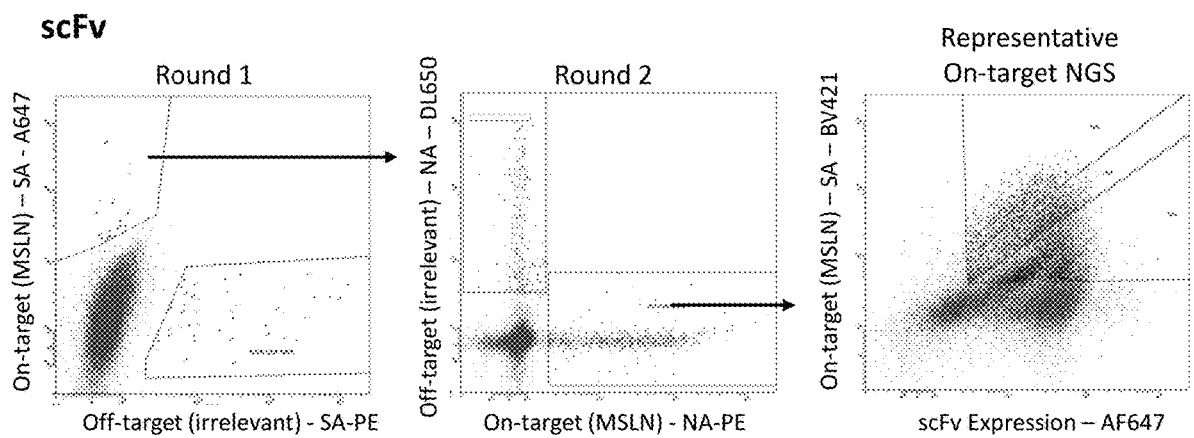
Figure 23C:
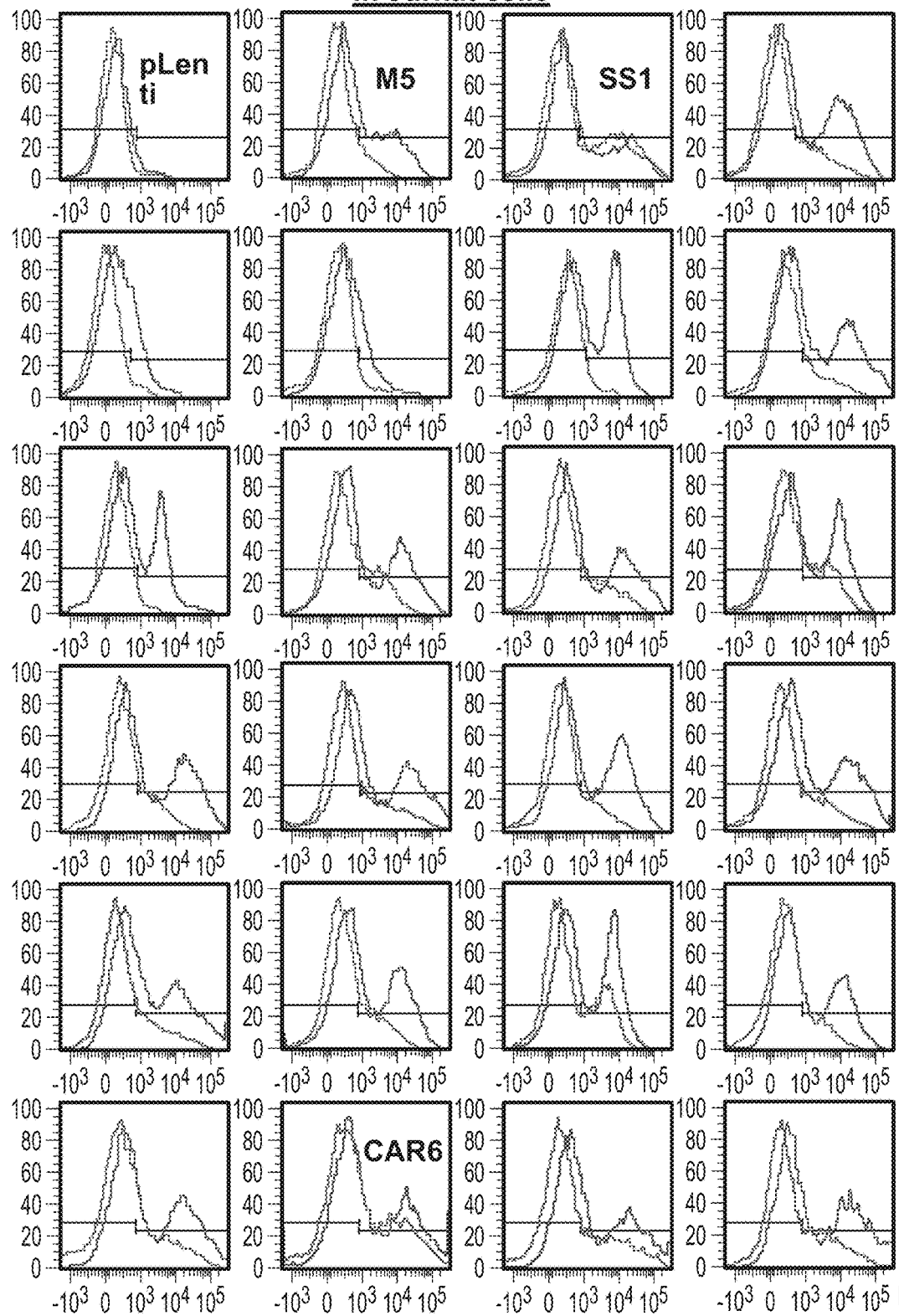
Figure 23D:
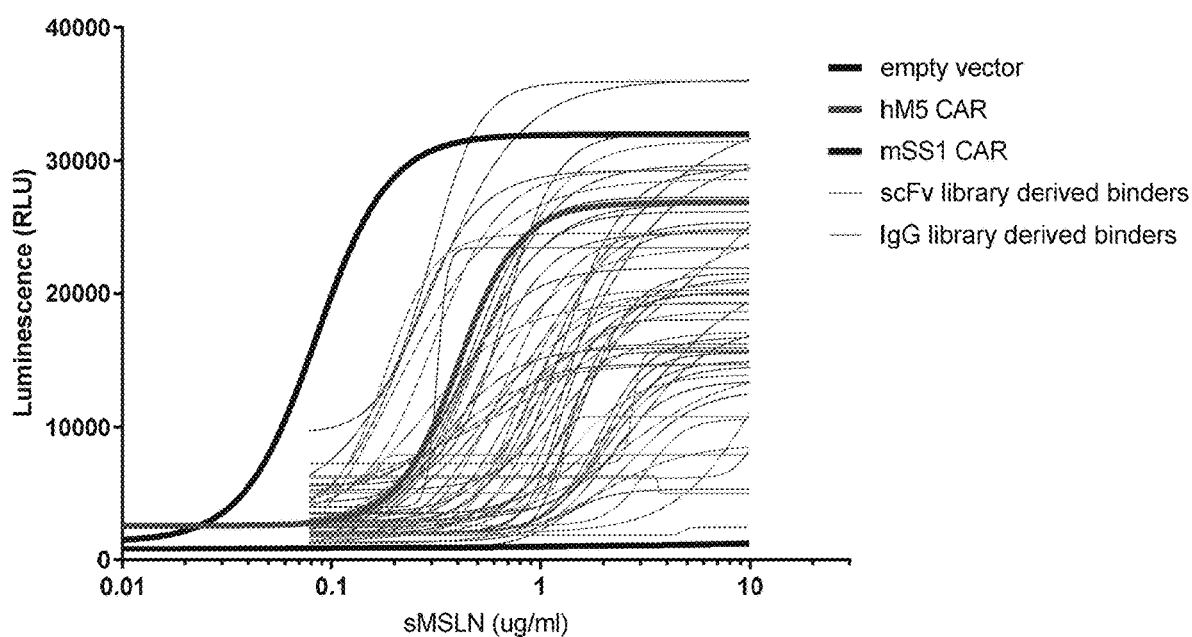

To identify potent, selective MSLN-directed ligand-binding domains (LBDs) that function in CARs, mammalian surface display libraries encoding either IgG antibodies (mAbs) or scFvs were screened (FIGS. 23A-23B). Soluble biotinylated MSLN labeled with fluorochrome were used as probe to enrich for cells in the library that stained for MSLN via FACS. As negative probe, a mixture of soluble CEA and EGFR was used to deplete cells encoding mAbs or scFvs with non-specific binding properties. After two rounds of enrichment for MSLN-binding, 62 individual LBDs were selected, converted to scFv CARs, confirmed for surface expression in Jurkat cells, and assessed for functional activity in solid-state Jurkat cell assays (FIGS. 23C-23D). This step allowed for the selection of a subset of the most sensitive, selective binders for further functional characterization.

While most of the 62 binders resulted in a functional response to cell surface displayed MSLN, six were selected for further characterization; sequences binder CDRs (heavy chain (HC) CDRs and light chain (LC) CDRs) and are provided in Table 2, Table 3 (heavy chain; VH) and Table 4 (light chain; VL). In each case, the HC-CDRs or VH may be paired with any of the LC-CDRs or VL, as the heavy chains and light chains share similarity, with routine testing to confirm desired expression and binding activity.

Single chain variable fragments (scFvs) may be generated by inserting a linker (e.g., GGGGSGGGGSGGGGSGG (SEQ ID NO: 152) or another suitable linker) between the VH and VL segments to form a VH-VL scFv; or VL-VH scFvs may alternatively be constructed. The light chains have high sequence similarity; pairing of VL and VH to generate full antibodies have been determined without undue experimentation. Illustrative scFvs are provided in Table 1, illustrative heavy and light chains are provided in Tables 3 and 4, and illustrative CDR sequences are provided in Table 2. Sequences of illustrative chimeric antigen receptors using the MSLN scFv are provided as Table 20, below.

TABLE 20

Sequences of Receptors comprising single chain variable fragments (scFv)

| # | SEQ ID NO | Receptor Sequence |
|---|---|---|
| 1 | 286 | EVQLVESGGGLVKPGGSLRLSCAASGFTFSNAWMSWVRQAP GKGLEWVGRIKSKTDGGTTDYAAPVKGRFTISRDDSKNTLYL QMNSLKTEDTAVYYCTTDLPKLRNFHIWGQGTLVTVSSGGG GSGGGGSGGGGSGGDIQMTQSPSSLSASVGDRVTITCRASQSI SSYLNWYQQKPGKAPKLLIYAASSLQSGVPSRFSGSGSGTDFT LTISSLQPEDFATYYCQQSYSTPLTFGGGTKVEIKTTTPAPRP PTPAPTIASQPLSLRPEACRPAAGGAVHTRGLDFACDFWVLVV VGGVLACYSLLVTVAFIIFWVRSKRSRLLHSDYMNMTPRRPGP TRKHYQPYAPPRDFAAYRSKRGRKKLLYIFKQPFMRPVQTTQ EEDGCSCRFPEEEEGGCELRVKFSRSADAPAYKQGQNQLYNE LNLGRREEYDVLDKRRGRDPEMGGKPRRKNPQEGLYNELQK DKMAEAYSEIGMKGERRRGKGHDGLYQGLSTATKDTYDALH MQALPPR |
| 2 | 287 | EVQLVESGGGLVQPGGSLRLSCAASGFTFSSYAMHWVRQAP GKGLEYVSAISSNGGSTYYANSVKGRFTISRDNSKNTLYLQM GSLRAEDMAVYYCASLEYHGFRQYGLRYWHWGQGTLVTVS SGGGGSGGGGSGGGGSGGDIQMTQSPSSLSASVGDRVTITCR ASQSISSYLNWYQQKPGKAPKLLIYAASSLQSGVPSRFSGSGS |

TABLE 20-continued

Sequences of Receptors comprising single chain variable fragments (scFv)

| # | SEQ ID NO | Receptor Sequence |
|---|---|---|
|  |  | GTDFTLTISSLQPEDFATYYCQQSYSTPLTFGGGTKVEIKTTTP APRPPTPAPTIASQPLSLRPEACRPAAGGAVHTRGLDFACDFW VLVVVGGVLACYSLLVTVAFIIFWVRSKRSRLLHSDYMNMTP RRPGPTRKHYQPYAPPRDFAAYRSKRGRKKLLYIFKQPFMRP VQTTQEEDGCSCRFPEEEEGGCELRVKFSRSADAPAYKQGQN QLYNELNLGRREEYDVLDKRRGRDPEMGGKPRRKNPQEGLY NELQKDKMAEAYSEIGMKGERRRGKGHDGLYQGLSTATKDT YDALHMQALPPR |
| 3 | 288 | QLQLQESGSGLVKPSQTLSLTCAVSGGSISSGGYSWSWIRQPP GKGLEWIGYIYHSGSTYYNPSLKSRVTISVDRSKNQFSLKLSS VTAADTAVYYCASIKFWFAGINYFFPWQGTLVTVSSGGGGS GGGGSGGGGSGGDIQMTQSPSSLSASVGDRVTITCRASQSISS YLNWYQQKPGKAPKLLIYAASSLQSGVPSRFSGSGSGTDFTLT ISSLQPEDFATYYCQQSYSTPLTFGGGTKVEIKTTTPAPRPPTP APTIASQPLSLRPEACRPAAGGAVHTRGLDFACDFWVLVVVG GVLACYSLLVTVAFIIFWVRSKRSRLLHSDYMNMTPRRPGPTR KHYQPYAPPRDFAAYRSKRGRKKLLYIFKQPFMRPVQTTQEE DGCSCRFPEEEEGGCELRVKFSRSADAPAYKQGQNQLYNELN LGRREEYDVLDKRRGRDPEMGGKPRRKNPQEGLYNELQKDK MAEAYSEIGMKGERRRGKGHDGLYQGLSTATKDTYDALHM QALPPR |
| 4 | 289 | EVQLVESGGGLVQPGGSLRLSCAASGFTFSSYWMHWVRQAP GKGLVWVSRINSDGSSTSYADSVKGRFTISRDNAKNTLYLQM NSLRAEDTAVYYCASGFLGMGSNPIWGQGTLVTVSSGGGGS GGGGSGGGGSGGDIQMTQSPSSLSASVGDRVTITCRASQSISS YLNWYQQKPGKAPKLLIYAASSLQSGVPSRFSGSGSGTDFTLT ISSLQPEDFATYYCQQSYSTPLTFGGGTKVEIKTTTPAPRPPTP APTIASQPLSLRPEACRPAAGGAVHTRGLDFACDFWVLVVVG GVLACYSLLVTVAFIIFWVRSKRSRLLHSDYMNMTPRRPGPTR KHYQPYAPPRDFAAYRSKRGRKKLLYIFKQPFMRPVQTTQEE DGCSCRFPEEEEGGCELRVKFSRSADAPAYKQGQNQLYNELN LGRREEYDVLDKRRGRDPEMGGKPRRKNPQEGLYNELQKDK MAEAYSEIGMKGERRRGKGHDGLYQGLSTATKDTYDALHM QALPPR |
| 5 | 290 | QVQLQESGPGLVKPSQTLSLTCTVSGGSISSGGYYWSWIRQHP GKGLEWIGYIYYSGSTYYNPSLKSLVTISVDTSKNQFSLKLS TSVAADTAVYYCASGDRARYFDLWGRGTLVTVSSGGGGSGGG GSGGGGSGGDIQMTQSPSSLSASVGDRVTITCRASQSISSYLN WYQQKPGKAPKLLIYAASSLQSGVPSRFSGSGSGTDFTLTIS SLQPEDFATYYCQQSYSTPLTFGGGTKVEIKTTTPAPRPPTP APTIASQPLSLRPEACRPAAGGAVHTRGLDFACDFWVLVVVG GVLACYSLLVTVAFIIFWVRSKRSRLLHSDYMNMTPRRPGPTR RKHYQPYAPPRDFAAYRSKRGRKKLLYIFKQPFMRPVQTTQE EDGCSCRFPEEEEGGCELRVKFSRSADAPAYKQGQNQLYNEL RNLGREEYDVLDKRRGRDPEMGGKPRRKNPQEGLYNELQKDK MAEAYSEIGMKGERRRGKGHDGLYQGLSTATKDTYDALHMQA LPPR |
| 6 | 291 | EVQLVESGGGLVQPGGSLRLSCAASGFTFSSYWMHWVRQAP GKGLVWVSRINSDGSSTSYADSVKGRFTISRDNAKNTLYLQ MNSLRAEDTAVYYCARYPRGYHQMVDAFDIWGQGTMVTVSS GGGGSGGGGSGGGGSGGDIQMTQSPSSLSASVGDRVTITCR ASQSISSYLNWYQQKPGKAPKLLIYAASSLQSGVPSRFSGS GSGTDFTLTISSLQPEDFATYYCQQSYSTPLTFGGGTKVEI KTTTPAPRPPTPAPTIASQPLSLRPEACRPAAGGAVHTRGL DFACDFWVLVVVGGVLACYSLLVTVAFIIFWVRSKRSRLLH SDYMNMTPRRPGPTRKHYQPYAPPRDFAAYRSKRGRKKLLY IFKQPFMRPVQTTQEEDGCSCRFPEEEEGGCELRVKFSRSA DAPAYKQGQNQLYNELNLGRREEYDVLDKRRGRDPEMGGKP RRKNPQEGLYNELQKDKMAEAYSEIGMKGERRRGKGHDGLY QGLSTATKDTYDALHMQALPPR |
| 7 | 292 | QLQLQESGPGLVKPSETLSLTCTVSGGSISSSSYYWGWIRQ PPGKGLEWIGSIYYSGSTYYNPSLKSRVTISVDTSKNQFSL KLSSVTAADTAVYYCARVRFLAARTTIPEANFLWGQGTLVT VSSGGGGSGGGGSGGGGSGGDIQMTQSPSSLSASVGDRVTI TCRASQSISSYLNWYQQKPGKAPKLLIYAASSLQSGVPSRF SGSGSGTDFTLTISSLQPEDFATYYCQQSYSTPLTFGGGTK VEIKTTTPAPRPPTPAPTIASQPLSLRPEACRPAAGGAVHT RGLDFACDFWVLVVVGGVLACYSLLVTVAFIIFWVRSKRSR LLHSDYMNMTPRRPGPTRKHYQPYAPPRDFAAYRSKRGRKK LLYIFKQPFMRPVQTTQEEDGCSCRFPEEEEGGCELRVKFS RSADAPAYKQGQNQLYNELNLGRREEYDVLDKRRGRDPEMG GKPRRKNPQEGLYNELQKDKMAEAYSEIGMKGERRRGKGHD GLYQGLSTATKDTYDALHMQALPPR |
| 8 | 293 | EVQLVESGGGLVQPGGSLRLSCAASGFTFSSYSMNWVRQAPG KGLEWVSYISSSSSTIYYADSVKGRFTISRDNAKNSLYLQMN SLRAEDTAVYYCARVLSRARFDYWGQGTLVTVSSGGGGSGGG GSGGGGSGGDIQMTQSPSSLSASVGDRVTITCRASQSISSYL NWYQQKPGKAPKLLIYAASSLQSGVPSRFSGSGSGTDFTLTI SSLQPEDFATYYCQQSYSTPLTFGGGTKVEIKTTTPAPRPPT PAPTIASQPLSLRPEACRPAAGGAVHTRGLDFACDFWVLVVV GGVLACYSLLVTVAFIIFWVRSKRSRLLHSDYMNMTPRRPGP TRKHYQPYAPPRDFAAYRSKRGRKKLLYIFKQPFMRPVQTTQ EEDGCSCRFPEEEEGGCELRVKFSRSADAPAYKQGQNQLYNE LNLGRREEYDVLDKRRGRDPEMGGKPRRKNPQEGLYNELQKD KMAEAYSEIGMKGERRRGKGHDGLYQGLSTATKDTYDALHMQ ALPPR |
| 9 | 294 | EVQLVESGGGLVKPGGSLRLSCAASGFTFSSYSMNWVRQAPG KGLEWVSSISSSSSYIYYADSVKGRFTISRDNAKNSLYLQMN SLRAEDTAVYYCARLRGRVFDPWGQGTLVTVSSGGGGSGGGG SGGGGSGGDIQMTQSPSSLSASVGDRVTITCRASQSISSYLN WYQQKPGKAPKLLIYAASSLQSGVPSRFSGSGSGTDFTLTIS SLQPEDFATYYCQQSYSTPLTFGGGTKVEIKTTTPAPRPPTP APTIASQPLSLRPEACRPAAGGAVHTRGLDFACDFWVLVVVG GVLACYSLLVTVAFIIFWVRSKRSRLLHSDYMNMTPRRPGPT RKHYQPYAPPRDFAAYRSKRGRKKLLYIFKQPFMRPVQTTQE EDGCSCRFPEEEEGGCELRVKFSRSADAPAYKQGQNQLYNEL NLGRREEYDVLDKRRGRDPEMGGKPRRKNPQEGLYNELQKDK MAEAYSEIGMKGERRRGKGHDGLYQGLSTATKDTYDALHMQA LPPR |
| 10 | 295 | QLQLQESGPGLVKPSETLSLTCTVSGGSISSSSYYWGWIRQP PGKGLEWIGSIYYSGSTYYNPSLKSRVTISVDTSKNQFSLKL SSVTAADTAVYYCARIKFTSFLYVHGFLWGQGTLVTVSSGGG GSGGGGSGGGGSGGDIQMTQSPSSLSASVGDRVTITCRASQS ISSYLNWYQQKPGKAPKLLIYAASSLQSGVPSRFSGSGSGTD FTLTISSLQPEDFATYYCQQSYSTPLTFGGGTKVEIKTTTPA PRPPTPAPTIASQPLSLRPEACRPAAGGAVHTRGLDFACDFW VLVVVGGVLACYSLLVTVAFIIFWVRSKRSRLLHSDYMNMTP RRPGPTRKHYQPYAPPRDFAAYRSKRGRKKLLYIFKQPFMRP VQTTQEEDGCSCRFPEEEEGGCELRVKFSRSADAPAYKQGQN QLYNELNLGRREEYDVLDKRRGRDPEMGGKPRRKNPQEGLYN ELQKDKMAEAYSEIGMKGERRRGKGHDGLYQGLSTATKDTYD ALHMQALPPR |
| 11 | 296 | QVQLVQSGAEVKKPGASVKVSCKASGYTFTSYAMHWVRQA PGQRLEWMGWINAGNGNTKYSQKFQGRVTITRDTSASTAYM ELSSLRSEDTAVYYCARGQRWLYLGGIRRHWGQGTLVTVSS GGGGSGGGGSGGGGSGGDIQMTQSPSSLSASVGDRVTITCR ASQSISSYLNWYQQKPGKAPKLLIYAASSLQSGVPSRFSGS GSGTDFTLTISSLQPEDFATYYCQQSYSTPLTFGGGTKVEI KTTTPAPRPPTPAPTIASQPLSLRPEACRPAAGGAVHTRGL DFACDFWVLVVVGGVLACYSLLVTVAFIIFWVRSKRSRLLH SDYMNMTPRRPGPTRKHYQPYAPPRDFAAYRSKRGRKKLLY IFKQPFMRPVQTTQEEDGCSCRFPEEEEGGCELRVKFSRSA DAPAYKQGQNQLYNELNLGRREEYDVLDKRRGRDPEMGGKP RRKNPQEGLYNELQKDKMAEAYSEIGMKGERRRGKGHDGLY DALHMQALPPR QGLSTATKDTY |
| 12 | 297 | QVQLQESGPGLVKPSETLSLTCTVSGGSISSYYWSWIRQPP GKGLEWIGYIYYSGSTNYNPSLKSRVTISVDTSKNQFSLKL SSVTAADTAVYYCAREWIPSRPYYFDYWGQGTLVTVSSGGG GSGGGGSGGGGSGGDIQMTQSPSSLSASVGDRVTITCRASQ SISSYLNWYQQKPGKAPKLLIYAASSLQSGVPSRFSGSGSG TDFTLTISSLQPEDFATYYCQQSYSTPLTFGGGTKVEIKTT TPAPRPPTPAPTIASQPLSLRPEACRPAAGGAVHTRGLDFA CDFWVLVVVGGVLACYSLLVTVAFIIFWVRSKRSRLLHSDY MNMTPRRPGPTRKHYQPYAPPRDFAAYRSKRGRKKLLYIFK QPFMRPVQTTQEEDGCSCRFPEEEEGGCELRVKFSRSADAP RREEYDVLDKRRGRDPEMGGKPRRKNPQEGLYNELQKDKM |

TABLE 20-continued

Sequences of Receptors comprising single chain variable fragments (scFv)

| SEQ ID NO | # | Receptor Sequence |
|---|---|---|
| | | AYKQGQNQLYNELNLGAEAYSEIGMKGERRRGKGHDGLYQGLSTATKDTYDALHMQALPPR |
| 13 | 298 | QVQLQESGPGLVKPSQTLSLTCTVSGGSISSGGYYWSWIRQPPGKGLEWIGYIYYSGSTYYNPSLKSRVTISVDTSKNQFTSLKLSSVAADTAVYYCARESTGTGAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 14 | 299 | EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCARERYRRVLHWYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSDSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 15 | 300 | QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCAREPDAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 16 | 301 | QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREHMGTIPYYFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 17 | 302 | QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREEFGYGDVLYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 18 | 303 | QVQLQESGPGLVKPSQTLSLTCTVSGGSISSGDYYWSWIRQPPGKGLEWIGYIYYSGSTYYNPSLKSRVTISVDTSKNQFSLKLSSVTAADTAVYYCAREDVVKGAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 19 | 304 | EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCAREDFSHKLGYFQHWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 20 | 305 | QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDYDYVWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 21 | 306 | QVQLQESGPGLVKPSQTLSLTCTVSGGSISSGDYYWSWIRQPPGKGLEWIGYIYYSGSTYYNPSLKSRVTISVDTSKNQFSLKLSSVTAADTAVYYCARDRRDWDWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 22 | 307 | QVQLQESGPGLVKPSGTLSLTCAVSGGSISSNWWSWVRQPPGKGLEWIGEIYHSGSTNYNPSLKSRVTISVDKSKNQFSLKLSSVTAADTAVYYCARDQQALKYRVDWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTPPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 23 | 308 | QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDLTLGCFDYWGQGTLVTVSSGGGGSGGGGSGGGGSGGDIQMTQSPSSLSASVGDRVTITCRASQSISS |

TABLE 20-continued

Sequences of Receptors comprising single chain variable fragments (scFv)

| # | SEQ ID NO | Receptor Sequence |
|---|---|---|
|  |  | YLNWYQQKPGKAPKLLIYAASSLQSGVPSRFSGSGSGTDFTLT ISSLQPEDFATYYCQQSYSTPLTFGGGTKVEIKTTTPAPRPPTP APTIASQPLSLRPEACRPAAGGAVHTRGLDFACDFWVLVVVG GVLACYSLLVTVAFIIFWVRSKRSRLLHSDYMNMTPRRPGPTR KHYQPYAPPRDFAAYRSKRGRKKLLYIFKQPFMRPVQTTQEE DGCSCRFPEEEEGGCELRVKFSRSADAPAYKQGQNQLYNELN LGRREEYDVLDKRRGRDPEMGGKPRRKNPQEGLYNELQKDK MAEAYSEIGMKGERRRGKGHDGLYQGLSTATKDTYDALHM QALPPR |
| 24 | 309 | EVQLVESGGGLVQPGGSLRLSCAASGFTVSSNYMSWVRQAP GKGLEWVSVIYSGGSTYYADSVKGRFTISRDNSKNTLYLQMN SLRAEDTAVYYCARDGSNSWYFDLWGRGTLVTVSSGGGGSG GGGSGGGGSGGDIQMTQSPSSLSASVGDRVTITCRASQSISSYL NWYQQKPGKAPKLLIYAASSLQSGVPSRFSGSGSGTDFTLTISS LQPEDFATYYCQQSYSTPLTFGGGTKVEIKTTTPAPRPPTPAPT IASQPLSLRPEACRPAAGGAVHTRGLDFACDFWVLVVVGGVL ACYSLLVTVAFIIFWVRSKRSRLLHSDYMNMTPRRPGPTRKH YQPYAPPRDFAAYRSKRGRKKLLYIFKQPFMRPVQTTQEEDG CSCRFPEEEEGGCELRVKFSRSADAPAYKQGQNQLYNELNLG RREEYDVLDKRRGRDPEMGGKPRRKNPQEGLYNELQKDKM AEAYSEIGMKGERRRGKGHDGLYQGLSTATKDTYDALHMQA LPPR |
| 25 | 310 | QVQLVESGGGVVQPGRSLRLSCAASGFTFSSYGMHWVRQAP GKGLEWVAVIWYDGSNKYYADSVKGRFTISRDNSKNTLYLQ MNSLRAEDTAVYYCARAFLFLSFSVWGQGTLVTVSSGGGGS GGGGSGGGGSGGDIQMTQSPSSLSASVGDRVTITCRASQSISS YLNWYQQKPGKAPKLLIYAASSLQSGVPSRFSGSGSGTDFTLT ISSLQPEDFATYYCQQSYSTPLTFGGGTKVEIKTTTPAPRPPTP APTIASQPLSLRPEACRPAAGGAVHTRGLDFACDFWVLVVVG GVLACYSLLVTVAFIIFWVRSKRSRLLHSDYMNMTPRRPGPTR KHYQPYAPPRDFAAYRSKRGRKKLLYIFKQPFMRPVQTTQEE DGCSCRFPEEEEGGCELRVKFSRSADAPAYKQGQNQLYNELN LGRREEYDVLDKRRGRDPEMGGKPRRKNPQEGLYNELQKDK MAEAYSEIGMKGERRRGKGHDGLYQGLSTATKDTYDALHMQ ALPPR |
| 26 | 311 | EVQLVESGGVVVQPGGSLRLSCAASGFTFDDYTMHWVRQAP GKGLEWVSLISWDGGSTYYADSVKGRFTISRDNSKNSLYLQM NSLRTEDTALYYCAKGIFYSSKEDFDYWGQGTLVTVSSGGGG SGGGGSGGGGSGGDIQMTQSPSSLSASVGDRVTITCRASQSISS YLNWYQQKPGKAPKLLIYAASSLQSGVPSRFSGSGSGTDFTLT ISSLQPEDFATYYCQQSYSTPLTFGGGTKVEIKTTTPAPRPPTP APTIASQPLSLRPEACRPAAGGAVHTRGLDFACDFWVLVVVG GVLACYSLLVTVAFIIFWVRSKRSRLLHSDYMNMTPRRPGPTR KHYQPYAPPRDFAAYRSKRGRKKLLYIFKQPFMRPVQTTQEE DGCSCRFPEEEEGGCELRVKFSRSADAPAYKQGQNQLYNELN LGRREEYDVLDKRRGRDPEMGGKPRRKNPQEGLYNELQKDK MAEAYSEIGMKGERRRGKGHDGLYQGLSTATKDTYDALHMQ ALPPR |
| 27 | 312 | EVQLVESGGVVVQPGGSLRLSCAASGFTFDDYTMHWVRQAP GKGLEWVSLISWDGGSTYYADSVKGRFTISRDNSKNSLYLQM NSLRTEDTALYYCAKDIWIFYSSNPKPTVYWGQGTLVTVSSG GGGSGGGGSGGGGSGGDIQMTQSPSSLSASVGDRVTITCRAS QSISSYLNWYQQKPGKAPKLLIYAASSLQSGVPSRFSGSGSGT DFTLTISSLQPEDFATYYCQQSYSTPLTFGGGTKVEIKTTTPAP RPPTPAPTIASQPLSLRPEACRPAAGGAVHTRGLDFACDFWVL VVVGGVLACYSLLVTVAFIIFWVRSKRSRLLHSDYMNMTPRR PGPTRKHYQPYAPPRDFAAYRSKRGRKKLLYIFKQPFMRPVQ TTQEEDGCSCRFPEEEEGGCELRVKFSRSADAPAYKQGQNQL YNELNLGRREEYDVLDKRRGRDPEMGGKPRRKNPQEGLYNE LQKDKMAEAYSEIGMKGERRRGKGHDGLYQGLSTATKDTYD ALHMQALPPR |
| 28 | 313 | QVQLVQSGSELKKPGASVKVSCKASGYTFTSYAMNWVRQAP GQGLEWMGWINTNTGNPTYAQGFTGRFVFSFDTSVSTAYLQI CSLKAEDTAVYYCARKDQTLTYGNWFDPWGQGTLVTVSSGG GGSGGGGSGGGGSGGDIQMTQSPSSLSASVGDRVTITCRASQS ISSYLNWYQQKPGKAPKLLIYAASSLQSGVPSRFSGSGSGTDF TLTISSLQPEDFATYYCQQSYSTPLTFGGGTKVEIKTTTPAPRPP TPAPTIASQPLSLRPEACRPAAGGAVHTRGLDFACDFWVLVV |

TABLE 20-continued

Sequences of Receptors comprising single chain variable fragments (scFv)

| # | SEQ ID NO | Receptor Sequence |
|---|---|---|
|  |  | VGGVLACYSLLVTVAFIIFWVRSKRSRLLHSDYMNMTPRRPG PTRKHYQPYAPPRDFAAYRSKRGRKKLLYIFKQPFMRPVQTT QEEDGCSCRFPEEEEGGCELRVKFSRSADAPAYKQGQNQLYN ELNLGRREEYDVLDKRRGRDPEMGGKPRRKNPQEGLYNELQ KDKMAEAYSEIGMKGERRRGKGHDGLYQGLSTATKDTYDAL HMQALPPR |
| 29 | 314 | QVQLQESGPGLVKPSETLSLTCTVSGGSVSSGSYYWSWIRQPP GKGLEWIGYIYYSGSTNYNPSLKSRVTISVDTSKNQFSLKLSSV TAADTAVYYCARDHYERGLYWGQGTLVTVSSGGGGSGGGG SGGGGSGGDIQMTQSPSSLSASVGDRVTITCRASQSISSYLNW YQQKPGKAPKLLIYAASSLQSGVPSRFSGSGSGTDFTLTISSLQ PEDFATYYCQQSYSTPLTFGGGTKVEIKTTTPAPRPPTPAPTIA SQPLSLRPEACRPAAGGAVHTRGLDFACDFWVLVVVGGVLA CYSLLVTVAFIIFWVRSKRSRLLHSDYMNMTPRRPGPTRKHY QPYAPPRDFAAYRSKRGRKKLLYIFKQPFMRPVQTTQEEDGC SCRFPEEEEGGCELRVKFSRSADAPAYKQGQNQLYNELNLGR REEYDVLDKRRGRDPEMGGKPRRKNPQEGLYNELQKDKMA EAYSEIGMKGERRRGKGHDGLYQGLSTATKDTYDALHMQAL PPR |
| 30 | 315 | QVQLVESGGGLVKPGGSLRLSCAASGFTFSDYYMSWIRQAPG KGLEWVSYISSSGSTIYYADSVKGRFTISRDNAKNSLYLQMNS LRAEDTAVYYCARYMYNWYFDLWGRGTLVTVSSGGGGSGG GGSGGGGSGGDIQMTQSPSSVSASVGDRVTITCRASQGISSWL AWYQQKPGKAPKLLIYAASSLQSGVPSRFSGSGSGTDFTLTISS LQPEDFATYYCQQANSFPLTFGGGTKVEIKTTTPAPRPPTPAPT IASQPLSLRPEACRPAAGGAVHTRGLDFACDFWVLVVVGGVL ACYSLLVTVAFIIFWVRSKRSRLLHSDYMNMTPRRPGPTRKH YQPYAPPRDFAAYRSKRGRKKLLYIFKQPFMRPVQTTQEEDG CSCRFPEEEEGGCELRVKFSRSADAPAYKQGQNQLYNELNLG RREEYDVLDKRRGRDPEMGGKPRRKNPQEGLYNELQKDKM AEAYSEIGMKGERRRGKGHDGLYQGLSTATKDTYDALHMQA LPPR |
| 31 | 316 | QVQLVESGGGLVKPGGSLRLSCAASGFTFSDYYMSWIRQAPG KGLEWVSYISSSGSTIYYADSVKGRFTISRDNAKNSLYLQMNS LRAEDTAVYYCARDRRPAFDIWGQGTMVTVSSGGGGSGGGG SGGGGSGGDIQMTQSPSSVSASVGDRVTITCRASQGISSWLAW YQQKPGKAPKLLIYAASSLQSGVPSRFSGSGSGTDFTLTISSLQ PEDFATYYCQQANSFPLTFGGGTKVEIKTTTPAPRPPTPAPTIA SQPLSLRPEACRPAAGGAVHTRGLDFACDFWVLVVVGGVLA CYSLLVTVAFIIFWVRSKRSRLLHSDYMNMTPRRPGPTRKHY QPYAPPRDFAAYRSKRGRKKLLYIFKQPFMRPVQTTQEEDGC SCRFPEEEEGGCELRVKFSRSADAPAYKQGQNQLYNELNLGR REEYDVLDKRRGRDPEMGGKPRRKNPQEGLYNELQKDKMA EAYSEIGMKGERRRGKGHDGLYQGLSTATKDTYDALHMQAL PPR |
| 32 | 317 | QVQLVESGGGLVKPGGSLRLSCAASGFTFSDYYMSWIRQAPG KGLEWVSYISSSGSTIYYADSVKGRFTISRDNAKNSLYLQMNS LRAEDTAVYYCAVHLKRRPYFDYWGQGTLVTVSSGGGGSGG GGSGGGGSGGAIQLTQSPSSLSASVGDRVTITCRASQGISSALA WYQQKPGKAPKLLIYDASSLESGVPSRFSGSGSGTDFTLTISSL QPEDFATYYCQQFNSYPLTFGGGTKVEIKTTTPAPRPPTPAPTI ASQPLSLRPEACRPAAGGAVHTRGLDFACDFWVLVVVGGVL ACYSLLVTVAFIIFWVRSKRSRLLHSDYMNMTPRRPGPTRKH YQPYAPPRDFAAYRSKRGRKKLLYIFKQPFMRPVQTTQEEDG CSCRFPEEEEGGCELRVKFSRSADAPAYKQGQNQLYNELNLG RREEYDVLDKRRGRDPEMGGKPRRKNPQEGLYNELQKDKM AEAYSEIGMKGERRRGKGHDGLYQGLSTATKDTYDALHMQA LPPR |
| 33 | 318 | QVQLVESGGGLVKPGGSLRLSCAASGFTFSDYYMSWIRQAPG KGLEWVSYISSSGSTIYYADSVKGRFTISRDNAKNSLYLQMNS LRAEDTAVYYCASVHKKPIFDYWGQGTLVTVSSGGGGSGGG GSGGGGSGGAIQLTQSPSSLSASVGDRVTITCRASQGISSALA WYQQKPGKAPKLLIYDASSLESGVPSRFSGSGSGTDFTLTISSL QPEDFATYYCQQFNSYPLTFGGGTKVEIKTTTPAPRPPTPAPTI ASQPLSLRPEACRPAAGGAVHTRGLDFACDFWVLVVVGGVL ACYSLLVTVAFIIFWVRSKRSRLLHSDYMNMTPRRPGPTRKH YQPYAPPRDFAAYRSKRGRKKLLYIFKQPFMRPVQTTQEEDG CSCRFPEEEEGGCELRVKFSRSADAPAYKQGQNQLYNELNLG |

TABLE 20-continued

Sequences of Receptors comprising single
chain variable fragments (scFv)

| SEQ ID NO | Receptor Sequence |
|---|---|
| | RREEYDVLDKRRGRDPEMGGKPRRKNPQEGLYNELQKDKM
AEAYSEIGMKGERRRGKGHDGLYQGLSTATKDTYDALHMQA
LPPR |
| 34 319 | QVQLVESGGGLVKPGGSLRLSCAASGFTFSDYYMSWIRQAPG
KGLEWVSYISSSGSTIYYADSVKGRFTISRDNAKNSLYLQMNS
LRAEDTAVYYCASTSRRCTFQHWGQGTLVTVSSGGGGSGGG
GSGGGGSGGAIQLTQSPSSLSASVGDRVTITCRASQGISSALA
WYQQKPGKAPKLLIYDASSLESGVPSRFSGSGSGTDFTLTISSL
QPEDFATYYCQQFNSYPLTFGGGTKVEIKTTTPAPRPPTPAPTI
ASQPLSLRPEACRPAAGGAVHTRGLDFACDFWVLVVVGGVL
ACYSLLVTVAFIIFWVRSKRSRLLHSDYMNMTPRRPGPTRKH
YQPYAPPRDFAAYRSKRGRKKLLYIFKQPFMRPVQTTQEEDG
CSCRFPEEEEGGCELRVKFSRSADAPAYKQGQNQLYNELNLG
RREEYDVLDKRRGRDPEMGGKPRRKNPQEGLYNELQKDKM
AEAYSEIGMKGERRRGKGHDGLYQGLSTATKDTYDALHMQA
LPPR |
| 35 320 | QVQLVESGGGLVKPGGSLRLSCAASGFTFSDYYMSWIRQAPG
KGLEWVSYISSSGSTIYYADSVKGRFTISRDNAKNSLYLQMNS
LRAEDTAVYYCASTSPRPLFQHWGQGTLVTVSSGGGGSGGG
GSGGGGSGGAIQLTQSPSSLSASVGDRVTITCRASQGISSALA
WYQQKPGKAPKLLIYDASSLESGVPSRFSGSGSGTDFTLTISSL
QPEDFATYYCQQFNSYPLTFGGGTKVEIKTTTPAPRPPTPAPTI
ASQPLSLRPEACRPAAGGAVHTRGLDFACDFWVLVVVGGVL
ACYSLLVTVAFIIFWVRSKRSRLLHSDYMNMTPRRPGPTRKH
YQPYAPPRDFAAYRSKRGRKKLLYIFKQPFMRPVQTTQEEDG
CSCRFPEEEEGGCELRVKFSRSADAPAYKQGQNQLYNELNLG
RREEYDVLDKRRGRDPEMGGKPRRKNPQEGLYNELQKDKM
AEAYSEIGMKGERRRGKGHDGLYQGLSTATKDTYDALHMQA
LPPR |
| 36 321 | QVQLVESGGGLVKPGGSLRLSCAASGFTFSDYYMSWIRQAPG
KGLEWVSYISSSGSTIYYADSVKGRFTISRDNAKNSLYLQMNS
LRAEDTAVYYCASPYQVRGVYFDYWGQGTLVTVSSGGGGSG
GGGSGGGGSGGAIQLTQSPSSLSASVGDRVTITCRASQGISSAL
AWYQQKPGKAPKLLIYDASSLESGVPSRFSGSGSGTDFTLTISS
LQPEDFATYYCQQFNSYPLTFGGGTKVEIKTTTPAPRPPTPAPT
IASQPLSLRPEACRPAAGGAVHTRGLDFACDFWVLVVVGGVL
ACYSLLVTVAFIIFWVRSKRSRLLHSDYMNMTPRRPGPTRKH
YQPYAPPRDFAAYRSKRGRKKLLYIFKQPFMRPVQTTQEEDG
CSCRFPEEEEGGCELRVKFSRSADAPAYKQGQNQLYNELNLG
RREEYDVLDKRRGRDPEMGGKPRRKNPQEGLYNELQKDKM
AEAYSEIGMKGERRRGKGHDGLYQGLSTATKDTYDALHMQA
LPPR |
| 37 322 | QVQLVESGGGLVKPGGSLRLSCAASGFTFSDYYMSWIRQAPG
KGLEWVSYISSSGSTIYYADSVKGRFTISRDNAKNSLYLQMNS
LRAEDTAVYYCASPYKKRRTVFDYWGQGTLVTVSSGGGGSG
GGGSGGGGSGGAIQLTQSPSSLSASVGDRVTITCRASQGISSAL
AWYQQKPGKAPKLLIYDASSLESGVPSRFSGSGSGTDFTLTISS
LQPEDFATYYCQQFNSYPLTFGGGTKVEIKTTTPAPRPPTPAPT
IASQPLSLRPEACRPAAGGAVHTRGLDFACDFWVLVVVGGVL
ACYSLLVTVAFIIFWVRSKRSRLLHSDYMNMTPRRPGPTRKH
YQPYAPPRDFAAYRSKRGRKKLLYIFKQPFMRPVQTTQEEDG
CSCRFPEEEEGGCELRVKFSRSADAPAYKQGQNQLYNELNLG
RREEYDVLDKRRGRDPEMGGKPRRKNPQEGLYNELQKDKM
AEAYSEIGMKGERRRGKGHDGLYQGLSTATKDTYDALHMQA
LPPR |
| 38 323 | QVQLVESGGGLVKPGGSLRLSCAASGFTFSDYYMSWIRQAPG
KGLEWVSYISSSGSTIYYADSVKGRFTISRDNAKNSLYLQMNS
LRAEDTAVYYCASLQRGLALFQHWGQGTLVTVSSGGGGSGG
GGSGGGGSGGAIQLTQSPSSLSASVGDRVTITCRASQGISSALA
WYQQKPGKAPKLLIYDASSLESGVPSRFSGSGSGTDFTLTISSL
QPEDFATYYCQQFNSYPLTFGGGTKVEIKTTTPAPRPPTPAPTI
ASQPLSLRPEACRPAAGGAVHTRGLDFACDFWVLVVVGGVL
ACYSLLVTVAFIIFWVRSKRSRLLHSDYMNMTPRRPGPTRKH
YQPYAPPRDFAAYRSKRGRKKLLYIFKQPFMRPVQTTQEEDG
CSCRFPEEEEGGCELRVKFSRSADAPAYKQGQNQLYNELNLG
RREEYDVLDKRRGRDPEMGGKPRRKNPQEGLYNELQKDKM
AEAYSEIGMKGERRRGKGHDGLYQGLSTATKDTYDALHMQA
LPPR |
| 39 324 | QVQLVESGGGLVKPGGSLRLSCAASGFTFSDYYMSWIRQAPG
KGLEWVSYISSSGSTIYYADSVKGRFTISRDNAKNSLYLQMNS
LRAEDTAVYYCASILSVPYFDLWGRGTLVTVSSGGGGSGGGG
SGGGGSGGAIQLTQSPSSLSASVGDRVTITCRASQGISSALAW
YQQKPGKAPKLLIYDASSLESGVPSRFSGSGSGTDFTLTISSLQ
PEDFATYYCQQFNSYPLTFGGGTKVEIKTTTPAPRPPTPAPTIA
SQPLSLRPEACRPAAGGAVHTRGLDFACDFWVLVVVGGVLA
CYSLLVTVAFIIFWVRSKRSRLLHSDYMNMTPRRPGPTRKHY
QPYAPPRDFAAYRSKRGRKKLLYIFKQPFMRPVQTTQEEDGC
SCRFPEEEEGGCELRVKFSRSADAPAYKQGQNQLYNELNLGR
REEYDVLDKRRGRDPEMGGKPRRKNPQEGLYNELQKDKMA
EAYSEIGMKGERRRGKGHDGLYQGLSTATKDTYDALHMQAL
PPR |
| 40 325 | QVQLVESGGGLVKPGGSLRLSCAASGFTFSDYYMSWIRQAPG
KGLEWVSYISSSGSTIYYADSVKGRFTISRDNAKNSLYLQMNS
LRAEDTAVYYCASGWIRVPLRLPLFQHWGQGTLVTVSSGGG
GSGGGGSGGGGSGGAIQLTQSPSSLSASVGDRVTITCRASQGIS
SALAWYQQKPGKAPKLLIYDASSLESGVPSRFSGSGSGTDFTL
TISSLQPEDFATYYCQQFNSYPLTFGGGTKVEIKTTTPAPRPPT
PAPTIASQPLSLRPEACRPAAGGAVHTRGLDFACDFWVLVVV
GGVLACYSLLVTVAFIIFWVRSKRSRLLHSDYMNMTPRRPGP
TRKHYQPYAPPRDFAAYRSKRGRKKLLYIFKQPFMRPVQTTQ
EEDGCSCRFPEEEEGGCELRVKFSRSADAPAYKQGQNQLYNE
LNLGRREEYDVLDKRRGRDPEMGGKPRRKNPQEGLYNELQK
DKMAEAYSEIGMKGERRRGKGHDGLYQGLSTATKDTYDALH
MQALPPR |
| 41 326 | QVQLVESGGGLVKPGGSLRLSCAASGFTFSDYYMSWIRQAPG
KGLEWVSYISSSGSTIYYADSVKGRFTISRDNAKNSLYLQMNS
LRAEDTAVYYCARVTIFAIFDIWGQGTMVTVSSGGGGSGGGG
SGGGGSGGAIQLTQSPSSLSASVGDRVTITCRASQGISSALAW
YQQKPGKAPKLLIYDASSLESGVPSRFSGSGSGTDFTLTISSLQ
PEDFATYYCQQFNSYPLTFGGGTKVEIKTTTPAPRPPTPAPTIA
SQPLSLRPEACRPAAGGAVHTRGLDFACDFWVLVVVGGVLA
CYSLLVTVAFIIFWVRSKRSRLLHSDYMNMTPRRPGPTRKHY
QPYAPPRDFAAYRSKRGRKKLLYIFKQPFMRPVQTTQEEDGC
SCRFPEEEEGGCELRVKFSRSADAPAYKQGQNQLYNELNLGR
REEYDVLDKRRGRDPEMGGKPRRKNPQEGLYNELQKDKMA
EAYSEIGMKGERRRGKGHDGLYQGLSTATKDTYDALHMQAL
PPR |
| 42 327 | QVQLVESGGGLVKPGGSLRLSCAASGFTFSDYYMSWIRQAPG
KGLEWVSYISSSGSTIYYADSVKGRFTISRDNAKNSLYLQMNS
LRAEDTAVYYCARVGRGFVHFDLWGRGTLVTVSSGGGGSGG
GGSGGGGSGGAIQLTQSPSSLSASVGDRVTITCRASQGISSALA
WYQQKPGKAPKLLIYDASSLESGVPSRFSGSGSGTDFTLTISSL
QPEDFATYYCQQFNSYPLTFGGGTKVEIKTTTPAPRPPTPAPTI
ASQPLSLRPEACRPAAGGAVHTRGLDFACDFWVLVVVGGVL
ACYSLLVTVAFIIFWVRSKRSRLLHSDYMNMTPRRPGPTRKH
YQPYAPPRDFAAYRSKRGRKKLLYIFKQPFMRPVQTTQEEDG
CSCRFPEEEEGGCELRVKFSRSADAPAYKQGQNQLYNELNLG
RREEYDVLDKRRGRDPEMGGKPRRKNPQEGLYNELQKDKM
AEAYSEIGMKGERRRGKGHDGLYQGLSTATKDTYDALHMQA
LPPR |
| 43 328 | QVQLVESGGGLVKPGGSLRLSCAASGFTFSDYYMSWIRQAPG
KGLEWVSYISSSGSTIYYADSVKGRFTISRDNAKNSLYLQMNS
LRAEDTAVYYCARTSRGLCVLFDYWGQGTLVTVSSGGGGSG
GGGSGGGGSGGAIQLTQSPSSLSASVGDRVTITCRASQGISSAL
AWYQQKPGKAPKLLIYDASSLESGVPSRFSGSGSGTDFTLTISS
LQPEDFATYYCQQFNSYPLTFGGGTKVEIKTTTPAPRPPTPAPT
IASQPLSLRPEACRPAAGGAVHTRGLDFACDFWVLVVVGGVL
ACYSLLVTVAFIIFWVRSKRSRLLHSDYMNMTPRRPGPTRKH
YQPYAPPRDFAAYRSKRGRKKLLYIFKQPFMRPVQTTQEEDG
CSCRFPEEEEGGCELRVKFSRSADAPAYKQGQNQLYNELNLG
RREEYDVLDKRRGRDPEMGGKPRRKNPQEGLYNELQKDKM
AEAYSEIGMKGERRRGKGHDGLYQGLSTATKDTYDALHMQA
LPPR |
| 44 329 | QVQLVESGGGLVKPGGSLRLSCAASGFTFSDYYMSWIRQAPG
KGLEWVSYISSSGSTIYYADSVKGRFTISRDNAKNSLYLQMNS |

TABLE 20-continued

Sequences of Receptors comprising single chain variable fragments (scFv)

| SEQ ID NO | # | Receptor Sequence |
|---|---|---|
| | | LRAEDTAVYYCARSGPSSYWYFDLWGRGTLVTVSSGGGGSG GGGSGGGGSGGAIQLTQSPSSLSASVGDRVTITCRASQGISSAL AWYQQKPGKAPKLLIYDASSLESGVPSRFSGSGSGTDFTLTISS LQPEDFATYYCQQFNSYPLTFGGGTKVEIKTTTPAPRPPTPAPT IASQPLSLRPEACRPAAGGAVHTRGLDFACDFWVLVVVGGVL ACYSLLVTVAFIIFWVRSKRSLLHSDYMNMTPRRPGPTRKH YQPYAPPRDFAAYRSKRGRKKLLYIFKQPFMRPVQTTQEEDG CSCRFPEEEEGGCELRVKFSRSADAPAYKQGQNQLYNELNLG RREEYDVLDKRRGRDPEMGGKPRRKNPQEGLYNELQKDKM AEAYSEIGMKGERRRGKGHDGLYQGLSTATKDTYDALHMQA LPPR |
| 45 | 330 | QVQLVESGGGLVKPGGSLRLSCAASGFTFSDYYMSWIRQAPG KGLEWVSYISSSGSTIYYADSVKGRFTISRDNAKNSLYLQMNS LRAEDTAVYYCARNIYMGGIWFDPWGQGTLVTVSSGGGGSG GGGSGGGGSGGAIQLTQSPSSLSASVGDRVTITCRASQGISSAL AWYQQKPGKAPKLLIYDASSLESGVPSRFSGSGSGTDFTLTISS LQPEDFATYYCQQFNSYPLTFGGGTKVEIKTTTPAPRPPTPAPT IASQPLSLRPEACRPAAGGAVHTRGLDFACDFWVLVVVGGVL ACYSLLVTVAFIIFWVRSKRSLLHSDYMNMTPRRPGPTRKH YQPYAPPRDFAAYRSKRGRKKLLYIFKQPFMRPVQTTQEEDG CSCRFPEEEEGGCELRVKFSRSADAPAYKQGQNQLYNELNLG RREEYDVLDKRRGRDPEMGGKPRRKNPQEGLYNELQKDKM AEAYSEIGMKGERRRGKGHDGLYQGLSTATKDTYDALHMQA LPPR |
| 46 | 331 | QVQLVESGGGLVKPGGSLRLSCAASGFTFSDYYMSWIRQAPG KGLEWVSYISSSGSTIYYADSVKGRFTISRDNAKNSLYLQMNS LRAEDTAVYYCARLTVRTGAFDIWGQGTMVTVSSGGGGSGG GGSGGGGSGGAIQLTQSPSSLSASVGDRVTITCRASQGISSALA WYQQKPGKAPKLLIYDASSLESGVPSRFSGSGSGTDFTLTISSL QPEDFATYYCQQFNSYPLTFGGGTKVEIKTTTPAPRPPTPAPTI ASQPLSLRPEACRPAAGGAVHTRGLDFACDFWVLVVVGGVL ACYSLLVTVAFIIFWVRSKRSLLHSDYMNMTPRRPGPTRKH YQPYAPPRDFAAYRSKRGRKKLLYIFKQPFMRPVQTTQEEDG CSCRFPEEEEGGCELRVKFSRSADAPAYKQGQNQLYNELNLG RREEYDVLDKRRGRDPEMGGKPRRKNPQEGLYNELQKDKM AEAYSEIGMKGERRRGKGHDGLYQGLSTATKDTYDALHMQA LPPR |
| 47 | 332 | QVQLVESGGGLVKPGGSLRLSCAASGFTFSDYYMSWIRQAPG KGLEWVSYISSSGSTIYYADSVKGRFTISRDNAKNSLYLQMNS LRAEDTAVYYCARLRTAHLDFDLWGQGTLVTVSSGGGGSGG GGSGGGGSGGAIQLTQSPSSLSASVGDRVTITCRASQGISSALA WYQQKPGKAPKLLIYDASSLESGVPSRFSGSGSGTDFTLTISSL QPEDFATYYCQQFNSYPLTFGGGTKVEIKTTTPAPRPPTPAPTI ASQPLSLRPEACRPAAGGAVHTRGLDFACDFWVLVVVGGVL ACYSLLVTVAFIIFWVRSKRSLLHSDYMNMTPRRPGPTRKH YQPYAPPRDFAAYRSKRGRKKLLYIFKQPFMRPVQTTQEEDG CSCRFPEEEEGGCELRVKFSRSADAPAYKQGQNQLYNELNLG RREEYDVLDKRRGRDPEMGGKPRRKNPQEGLYNELQKDKM AEAYSEIGMKGERRRGKGHDGLYQGLSTATKDTYDALHMQA LPPR |
| 48 | 333 | QVQLVESGGGLVKPGGSLRLSCAASGFTFSDYYMSWIRQAPG KGLEWVSYISSSGSTIYYADSVKGRFTISRDNAKNSLYLQMNS LRAEDTAVYYCARDLIFPVVFDYWGQGTLVTVSSGGGGSGG GGSGGGGSGGAIQLTQSPSSLSASVGDRVTITCRASQGISSALA WYQQKPGKAPKLLIYDASSLESGVPSRFSGSGSGTDFTLTISSL QPEDFATYYCQQFNSYPLTFGGGTKVEIKTTTPAPRPPTPAPTI ASQPLSLRPEACRPAAGGAVHTRGLDFACDFWVLVVVGGVL ACYSLLVTVAFIIFWVRSKRSLLHSDYMNMTPRRPGPTRKH YQPYAPPRDFAAYRSKRGRKKLLYIFKQPFMRPVQTTQEEDG CSCRFPEEEEGGCELRVKFSRSADAPAYKQGQNQLYNELNLG RREEYDVLDKRRGRDPEMGGKPRRKNPQEGLYNELQKDKM AEAYSEIGMKGERRRGKGHDGLYQGLSTATKDTYDALHMQA LPPR |
| 49 | 334 | QVQLVESGGGLVKPGGSLRLSCAASGFTFSDYYMSWIRQAPG KGLEWVSYISSSGSTIYYADSVKGRFTISRDNAKNSLYLQMNS LRAEDTAVYYCARDGYRKYGYVFFDIWGQGTMVTVSSGGG GSGGGGSGGGGSGGAIQLTQSPSSLSASVGDRVTITCRASQGIS SALAWYQQKPGKAPKLLIYDASSLESGVPSRFSGSGSGTDFTL TISSLQPEDFATYYCQQFNSYPLTFGGGTKVEIKTTTPAPRPPT PAPTIASQPLSLRPEACRPAAGGAVHTRGLDFACDFWVLVVV GGVLACYSLLVTVAFIIFWVRSKRSLLHSDYMNMTPRRPGP TRKHYQPYAPPRDFAAYRSKRGRKKLLYIFKQPFMRPVQTTQ EEDGCSCRFPEEEEGGCELRVKFSRSADAPAYKQGQNQLYNE LNLGRREEYDVLDKRRGRDPEMGGKPRRKNPQEGLYNELQK DKMAEAYSEIGMKGERRRGKGHDGLYQGLSTATKDTYDALH MQALPPR |
| 50 | 335 | QVQLVESGGGLVKPGGSLRLSCAASGFTFSDYYMSWIRQAPG KGLEWVSYISSSGSTIYYADSVKGRFTISRDNAKNSLYLQMNS LRAEDTAVYYCARDGRYRRFWHAFDIWGQGTMVTVSSGGG GSGGGGSGGGGSGGAIQLTQSPSSLSASVGDRVTITCRASQGIS SALAWYQQKPGKAPKLLIYDASSLESGVPSRFSGSGSGTDFTL TISSLQPEDFATYYCQQFNSYPLTFGGGTKVEIKTTTPAPRPPT PAPTIASQPLSLRPEACRPAAGGAVHTRGLDFACDFWVLVVV GGVLACYSLLVTVAFIIFWVRSKRSLLHSDYMNMTPRRPGP TRKHYQPYAPPRDFAAYRSKRGRKKLLYIFKQPFMRPVQTTQ EEDGCSCRFPEEEEGGCELRVKFSRSADAPAYKQGQNQLYNE LNLGRREEYDVLDKRRGRDPEMGGKPRRKNPQEGLYNELQK DKMAEAYSEIGMKGERRRGKGHDGLYQGLSTATKDTYDALH MQALPPR |
| 51 | 336 | QVQLVESGGGLVKPGGSLRLSCAASGFTFSDYYMSWIRQAPG KGLEWVSYISSSGSTIYYADSVKGRFTISRDNAKNSLYLQMNS LRAEDTAVYYCARAHIRGYFDLWGRGTLVTVSSGGGGSGG GSGGGGSGGAIQLTQSPSSLSASVGDRVTITCRASQGISSALA WYQQKPGKAPKLLIYDASSLESGVPSRFSGSGSGTDFTLTISSL QPEDFATYYCQQFNSYPLTFGGGTKVEIKTTTPAPRPPTPAPTI ASQPLSLRPEACRPAAGGAVHTRGLDFACDFWVLVVVGGVL ACYSLLVTVAFIIFWVRSKRSLLHSDYMNMTPRRPGPTRKH YQPYAPPRDFAAYRSKRGRKKLLYIFKQPFMRPVQTTQEEDG CSCRFPEEEEGGCELRVKFSRSADAPAYKQGQNQLYNELNLG RREEYDVLDKRRGRDPEMGGKPRRKNPQEGLYNELQKDKM AEAYSEIGMKGERRRGKGHDGLYQGLSTATKDTYDALHMQA LPPR |
| 52 | 337 | EVQLLESGGGLVQPGGSLRLSCAASGFTFSSYAMSWVRQAPG KGLEWVSAISGSGGSTYYADSVKGRFTISRDNSKNTLYLQMN SLRAEDTAVYYCATWMGGGRWYFDLWGRGTLVTVSSGGG GSGGGGSGGGGSGGAIQLTQSPSSLSASVGDRVTITCRASQGIS SALAWYQQKPGKAPKLLIYDASSLESGVPSRFSGSGSGTDFTL TISSLQPEDFATYYCQQFNSYPLTFGGGTKVEIKTTTPAPRPPT PAPTIASQPLSLRPEACRPAAGGAVHTRGLDFACDFWVLVVV GGVLACYSLLVTVAFIIFWVRSKRSLLHSDYMNMTPRRPGP TRKHYQPYAPPRDFAAYRSKRGRKKLLYIFKQPFMRPVQTTQ EEDGCSCRFPEEEEGGCELRVKFSRSADAPAYKQGQNQLYNE LNLGRREEYDVLDKRRGRDPEMGGKPRRKNPQEGLYNELQK DKMAEAYSEIGMKGERRRGKGHDGLYQGLSTATKDTYDALH MQALPPR |
| 53 | 338 | EVQLLESGGGLVQPGGSLRLSCAASGFTFSSYAMSWVRQAPG KGLEWVSAISGSGGSTYYADSVKGRFTISRDNSKNTLYLQMN SLRAEDTAVYYCARTSRTTWYFDLWGRGTLVTVSSGGGGSG GGGSGGGGSGGAIQLTQSPSSLSASVGDRVTITCRASQGISSAL AWYQQKPGKAPKLLIYDASSLESGVPSRFSGSGSGTDFTLTISS LQPEDFATYYCQQFNNYPLTFGGGTKVEIKTTTPAPRPPTPAP TIASQPLSLRPEACRPAAGGAVHTRGLDFACDFWVLVVVGGV LACYSLLVTVAFIIFWVRSKRSLLHSDYMNMTPRRPGPTRKH YQPYAPPRDFAAYRSKRGRKKLLYIFKQPFMRPVQTTQEEDG CSCRFPEEEEGGCELRVKFSRSADAPAYKQGQNQLYNELNLG RREEYDVLDKRRGRDPEMGGKPRRKNPQEGLYNELQKDKM AEAYSEIGMKGERRRGKGHDGLYQGLSTATKDTYDALHMQA LPPR |
| 54 | 339 | EVQLLESGGGLVQPGGSLRLSCAASGFTFSSYAMSWVRQAPG KGLEWVSAISGSGGSTYYADSVKGRFTISRDNSKNTLYLQMN SLRAEDTAVYYCAKWMGGGGRLYFDLWGRGTLVTVSSGGG GSGGGGSGGGGSGGAIQLTQSPSSLSASVGDRVTITCRASQGIS SALAWYQQKPGKAPKLLIYDASSLESGVPSRFSGSGSGTDFTL TISSLQPEDFATYYCQQFNNYPLTFGGGTKVEIKTTTPAPRPPT PAPTIASQPLSLRPEACRPAAGGAVHTRGLDFACDFWVLVVV GGVLACYSLLVTVAFIIFWVRSKRSLLHSDYMNMTPRRPGP |

TABLE 20-continued

Sequences of Receptors comprising single chain variable fragments (scFv)

| # | SEQ ID NO | Receptor Sequence |
|---|---|---|
| | | TRKHYQPYAPPRDFAAYRSKRGRKKLLYIFKQPFMRPVQTTQ EEDGCSCRFPEEEEGGCELRVKFSRSADAPAYKQGQNQLYNE LNLGRREEYDVLDKRRGRDPEMGGKPRRKNPQEGLYNELQK DKMAEAYSEIGMKGERRRGKGHDGLYQGLSTATKDTYDALH MQALPPR |
| 55 | 340 | EVQLLESGGGLVQPGGSLRLSCAASGFTFSSYAMSWVRQAPG KGLEWVSAISGSGGSTYYADSVKGRFTISRDNSKNTLYLQMN SLRAEDTAVYYCAKWGGRLYWYFDLWGRGTLVTVSSGGGG SGGGGSGGGGSGGAIQLTQSPSSLSASVGDRVTITCRASQGISS ALAWYQQKPGKAPKLLIYDASSLESGVPSRFSGSGSGTDFTLT ISSLQPEDFATYYCQQFNNYPLTFGGGTKVEIKTTTPAPRPPTP APTIASQPLSLRPEACRPAAGGAVHTRGLDFACDFWVLVVVG GVLACYSLLVTVAFIIFWVRSKRSRLLHSDYMNMTPRRPGPTR KHYQPYAPPRDFAAYRSKRGRKKLLYIFKQPFMRPVQTTQEE DGCSCRFPEEEEGGCELRVKFSRSADAPAYKQGQNQLYNELN LGRREEYDVLDKRRGRDPEMGGKPRRKNPQEGLYNELQKDK MAEAYSEIGMKGERRRGKGHDGLYQGLSTATKDTYDALHM QALPPR |
| 56 | 341 | EVQLLESGGGLVQPGGSLRLSCAASGFTFSSYAMSWVRQAPG KGLEWVSAISGSGGSTYYADSVKGRFTISRDNSKNTLYLQMN SLRAEDTAVYYCAKVIRQLWYFDLWGRGTLVTVSSGGGGSG GGGSGGGGSGGAIQLTQSPSSLSASVGDRVTITCRASQGISSAL AWYQQKPGKAPKLLIYDASSLESGVPSRFSGSGSGTDFTLTISS LQPEDFATYYCQQFNNYPLTFGGGTKVEIKTTTPAPRPPTPAP TIASQPLSLRPEACRPAAGGAVHTRGLDFACDFWVLVVVGGV LACYSLLVTVAFIIFWVRSKRSRLLHSDYMNMTPRRPGPTRKH YQPYAPPRDFAAYRSKRGRKKLLYIFKQPFMRPVQTTQEEDG CSCRFPEEEEGGCELRVKFSRSADAPAYKQGQNQLYNELNLG RREEYDVLDKRRGRDPEMGGKPRRKNPQEGLYNELQKDKM AEAYSEIGMKGERRRGKGHDGLYQGLSTATKDTYDALHMQA LPPR |
| 57 | 342 | EVQLLESGGGLVQPGGSLRLSCAASGFTFSSYAMSWVRQAPG KGLEWVSAISGSGGSTYYADSVKGRFTISRDNSKNTLYLQMN SLRAEDTAVYYCAKVFANSWYFDLWGRGTLVTVSSGGGGSG GGGSGGGGSGGAIQLTQSPSSLSASVGDRVTITCRASQGISSAL AWYQQKPGKAPKLLIYDASSLESGVPSRFSGSGSGTDFTLTISS LQPEDFATYYCQQFNNYPLTFGGGTKVEIKTTTPAPRPPTPAP TIASQPLSLRPEACRPAAGGAVHTRGLDFACDFWVLVVVGGV LACYSLLVTVAFIIFWVRSKRSRLLHSDYMNMTPRRPGPTRKH YQPYAPPRDFAAYRSKRGRKKLLYIFKQPFMRPVQTTQEEDG CSCRFPEEEEGGCELRVKFSRSADAPAYKQGQNQLYNELNLG RREEYDVLDKRRGRDPEMGGKPRRKNPQEGLYNELQKDKM AEAYSEIGMKGERRRGKGHDGLYQGLSTATKDTYDALHMQA LPPR |
| 58 | 343 | EVQLLESGGGLVQPGGSLRLSCAASGFTFSSYAMSWVRQAPG KGLEWVSAISGSGGSTYYADSVKGRFTISRDNSKNTLYLQMN SLRAEDTAVYYCAKVDRTTWYFDLWGRGTLVTVSSGGGGSG GGGSGGGGSGGAIQLTQSPSSLSASVGDRVTITCRASQGISSAL AWYQQKPGKAPKLLIYDASSLESGVPSRFSGSGSGTDFTLTISS LQPEDFATYYCQQFNNYPLTFGGGTKVEIKTTTPAPRPPTPAP TIASQPLSLRPEACRPAAGGAVHTRGLDFACDFWVLVVVGGV LACYSLLVTVAFIIFWVRSKRSRLLHSDYMNMTPRRPGPTRKH YQPYAPPRDFAAYRSKRGRKKLLYIFKQPFMRPVQTTQEEDG CSCRFPEEEEGGCELRVKFSRSADAPAYKQGQNQLYNELNLG RREEYDVLDKRRGRDPEMGGKPRRKNPQEGLYNELQKDKM AEAYSEIGMKGERRRGKGHDGLYQGLSTATKDTYDALHMQA LPPR |
| 59 | 344 | EVQLLESGGGLVQPGGSLRLSCAASGFTFSSYAMSWVRQAPG KGLEWVSAISGSGGSTYYADSVKGRFTISRDNSKNTLYLQMN SLRAEDTAVYYCAKRWGKDGPYWYFDLWGRGTLVTVSSGGG GGSGGGGSGGGGSGGAIQLTQSPSSLSASVGDRVTITCRASQG ISSALAWYQQKPGKAPKLLIYDASSLESGVPSRFSGSGSGTDFT LTISSLQPEDFATYYCQQFNNYPLTFGGGTKVEIKTTTPAPRPP TPAPTIASQPLSLRPEACRPAAGGAVHTRGLDFACDFWVLVV VGGVLACYSLLVTVAFIIFWVRSKRSRLLHSDYMNMTPRRPG PTRKHYQPYAPPRDFAAYRSKRGRKKLLYIFKQPFMRPVQTT QEEDGCSCRFPEEEEGGCELRVKFSRSADAPAYKQGQNQLYN ELNLGRREEYDVLDKRRGRDPEMGGKPRRKNPQEGLYNELQ KDKMAEAYSEIGMKGERRRGKGHDGLYQGLSTATKDTYDAL HMQALPPR |
| 60 | 345 | EVQLLESGGGLVQPGGSLRLSCAASGFTFSSYAMSWVRQAPG KGLEWVSAISGSGGSTYYADSVKGRFTISRDNSKNTLYLQMN SLRAEDTAVYYCAKRRDSYGPYWYFDLWGRGTLVTVSSGGG GSGGGGSGGGGSGGAIQLTQSPSSLSASVGDRVTITCRASQGIS SALAWYQQKPGKAPKLLIYDASSLESGVPSRFSGSGSGTDFTL TISSLQPEDFATYYCQQFNNYPLTFGGGTKVEIKTTTPAPRPPT PAPTIASQPLSLRPEACRPAAGGAVHTRGLDFACDFWVLVVV GGVLACYSLLVTVAFIIFWVRSKRSRLLHSDYMNMTPRRPGP TRKHYQPYAPPRDFAAYRSKRGRKKLLYIFKQPFMRPVQTTQ EEDGCSCRFPEEEEGGCELRVKFSRSADAPAYKQGQNQLYNE LNLGRREEYDVLDKRRGRDPEMGGKPRRKNPQEGLYNELQK DKMAEAYSEIGMKGERRRGKGHDGLYQGLSTATKDTYDALH MQALPPR |
| 61 | 346 | EVQLLESGGGLVQPGGSLRLSCAASGFTFSSYAMSWVRQAPG KGLEWVSAISGSGGSTYYADSVKGRFTISRDNSKNTLYLQMN SLRAEDTAVYYCAKNRPPPGYWYFDLWGRGTLVTVSSGGGG SGGGGSGGGGSGGAIQLTQSPSSLSASVGDRVTITCRASQGISS ALAWYQQKPGKAPKLLIYDASSLESGVPSRFSGSGSGTDFTLT ISSLQPEDFATYYCQQFNNYPLTFGGGTKVEIKTTTPAPRPPTP APTIASQPLSLRPEACRPAAGGAVHTRGLDFACDFWVLVVVG GVLACYSLLVTVAFIIFWVRSKRSRLLHSDYMNMTPRRPGPTR KHYQPYAPPRDFAAYRSKRGRKKLLYIFKQPFMRPVQTTQEE DGCSCRFPEEEEGGCELRVKFSRSADAPAYKQGQNQLYNELN LGRREEYDVLDKRRGRDPEMGGKPRRKNPQEGLYNELQKDK MAEAYSEIGMKGERRRGKGHDGLYQGLSTATKDTYDALHM QALPPR |
| 62 | 347 | EVQLLESGGGLVQPGGSLRLSCAASGFTFSSYAMSWVRQAPG KGLEWVSAISGSGGSTYYADSVKGRFTISRDNSKNTLYLQMN SLRAEDTAVYYCAKGRRFSWYFDLWGRGTLVTVSSGGGGSG GGGSGGGGSGGAIQLTQSPSSLSASVGDRVTITCRASQGISSAL AWYQQKPGKAPKLLIYDASSLESGVPSRFSGSGSGTDFTLTISS LQPEDFATYYCQQFNNYPLTFGGGTKVEIKTTTPAPRPPTPAP TIASQPLSLRPEACRPAAGGAVHTRGLDFACDFWVLVVVGGV LACYSLLVTVAFIIFWVRSKRSRLLHSDYMNMTPRRPGPTRKH YQPYAPPRDFAAYRSKRGRKKLLYIFKQPFMRPVQTTQEEDG CSCRFPEEEEGGCELRVKFSRSADAPAYKQGQNQLYNELNLG RREEYDVLDKRRGRDPEMGGKPRRKNPQEGLYNELQKDKM AEAYSEIGMKGERRRGKGHDGLYQGLSTATKDTYDALHMQA LPPR |

Figure 24A:
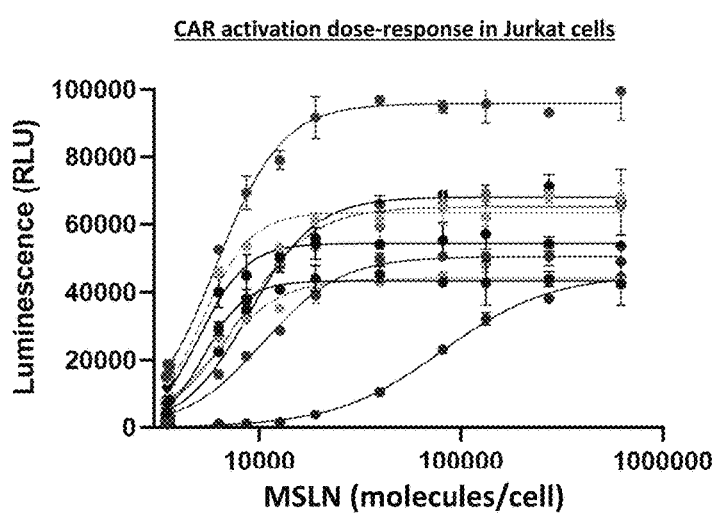
FIG. 24A shows the sensitivity of MSLN CARs vs. benchmark CARs M5, SS1 and m912. All constructs were Gen3 except SS1 (Gen2). Jurkat cell dose-response (RLU) was measured to assess the sensitivity in a 6 hour co-culture assay: (1) Titrated MSLN-encoding mRNA was used to transfect HEK293 cells; (2) QIFIKIT (quantitative analysis kit, Agilent) was used to convert flow-cytometry based surface expression to MSLN molecules/cell; and, (3) The molecule/cell sensitivities (EC50) of 6 novel and three benchmark CARs were calculated from fitting the dose-response curves. For those CARs with sensitivities below the limit of detection of the assay, EC50 was reported as <3000 MSLN molecules/cell. Maximum signal (Emax) for each construct was also noted. Experiments were repeated 1-4 times.

Six binders were expressed as third-generation (Gen3) chimeric antigen receptors (CAR1-CAR6) [corresponding to #16, 17, 18, 29, 55, and 59, respectively, in Tables 1-4 and 20], which were compared to anti-MSLN scFvs from the literature (SS1, M5 and m912) in Jurkat functional assays. The CARs displayed a range of sensitivities (EC50) and maximal responses ($E_{max}$) (FIG. 24A). All constructs were Gen3 except SS1 (Gen2). Jurkat cell dose-response (RLU) was measured to assess the sensitivity in a 6 hour co-culture assay: (1) Titrated MSLN-encoding mRNA was used to transfect HEK293 cells; (2) QIFIKIT (quantitative analysis kit, Agilent®) was used to convert flow-cytometry based surface expression to MSLN molecules/cell; and, (3) The molecule/cell sensitivities (EC50) of 6 novel and three benchmark CARs were calculated from fitting the dose-response curves. For those CARs with sensitivities below the limit of detection of the assay, EC50 was reported as <3000 MSLN molecules/cell. Maximum signal ($E_{max}$) for each construct was also noted. Experiments were repeated 1-4 times.

Table 21 shows the selectivity window and killing efficiency of HeLa cells by transduced primary T cells. Quantification of the selectivity window between killing of MSLN+A2− and MSLN+A2+ HeLa cells with activator and blocker+ primary T cells. Killing efficiency describes difference in killing of MSLN+A2− HeLa cells by activator and blocker+ T cells compared to activator+(only) T cells. Both measures are calculated up to the time corresponding to 80% maximum observed killing.

TABLE 21

| Activator | E:T (HeLa target) | Time (hours) to 80% max killing | Selectivity window | Killing efficiency |
|---|---|---|---|---|
| hM5 CAR | 4:1 | 28 | 6.9 | 1.2 |
| mSS1 CAR | 4:1 | 44 | 6.2 | 1.1 |
| CAR 18 | 4:1 | 24 | 21.4 | 1.1 |
| CAR 29 | 4:1 | 20 | 7.0 | 1.0 |
| hM5 CAR | 2:1 | 64 | 5.5 | 0.8 |
| mSS1 CAR | 2:1 | 72+ | n/d | 0.7 |
| CAR 18 | 2:1 | 56 | 20.3 | 0.8 |
| CAR 29 | 2:1 | 44 | 7.6 | 0.9 | n/d=not determined due to poor overall killing

Six binders (CAR1-6) were compared to benchmark MSLN scFvs from the literature (SS1, M5 and m912) in Jurkat functional assays [12-14]. All were expressed as Gen3 CARs, with the exception of Gen2 SS1. For MSLN(+) target cells, HEK293 cells transfected with synthetic MSLN mRNA were used. The CARs displayed a range of sensitivities (EC50) and maximal responses ($E_{max}$) (FIG. 24A). Of the six binders, all but CAR 16 exhibit higher sensitivity than hM5 and sSS1.

In short, an extensive campaign to identify anti-MSLN binders yielded hundreds of sequences identified in an NGS screen, and 62 candidate constructs were produced, all of which bind MSLN. Six of these shown superior activity. CAR 18 and CAR 29 demonstrated superior sensitivity to comparator CAR constructs.

Figure 24B:
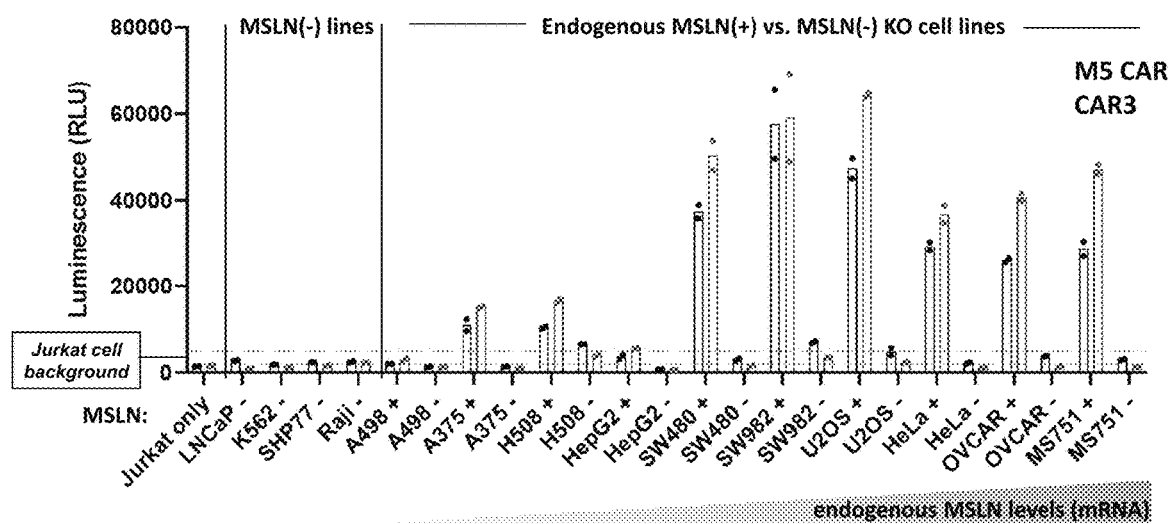
FIG. 24B shows CAR3 selectivity. An example of MSLN CAR3 selectivity benchmarked against the M5 CAR. Activation of CARs in a Jurkat cell functional assay by MSLN (+) or MSLN(−) cell lines was measured. For MSLN(+) cell lines, variant MSLN(−) versions were generated by MSLN knockout for comparison For more detailed off-target characterization, see FIG. 32B.
Figure 25A:
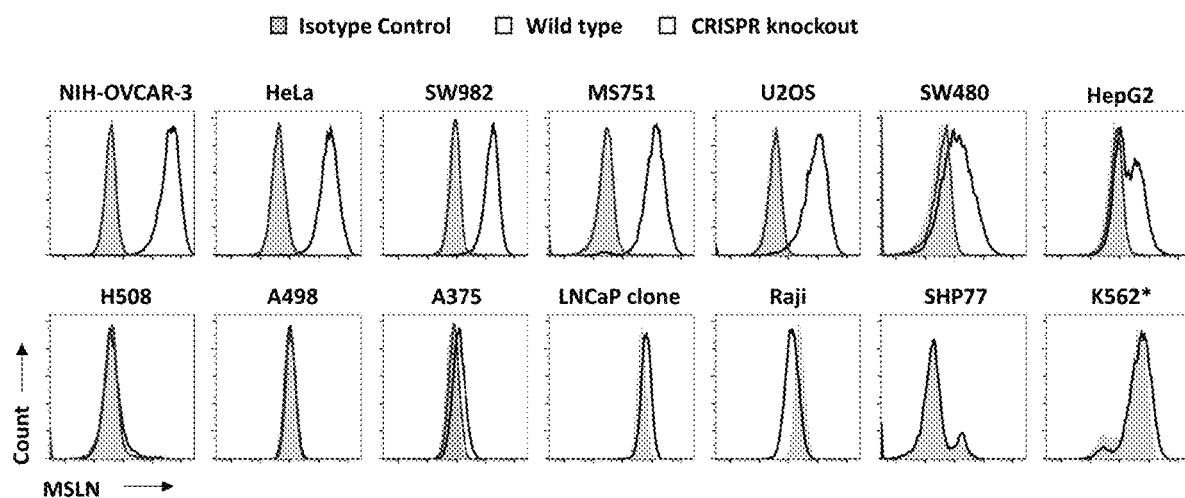
FIG. 25A shows expression of MSLN in human cell lines assessed by staining with MSLN mAb and flow cytometry. K562 displayed some cross-reactivity to the anti-MSLN antibody, although no functional reactivity to CAR3 or M5 benchmark CAR was observed.
Figure 27A:
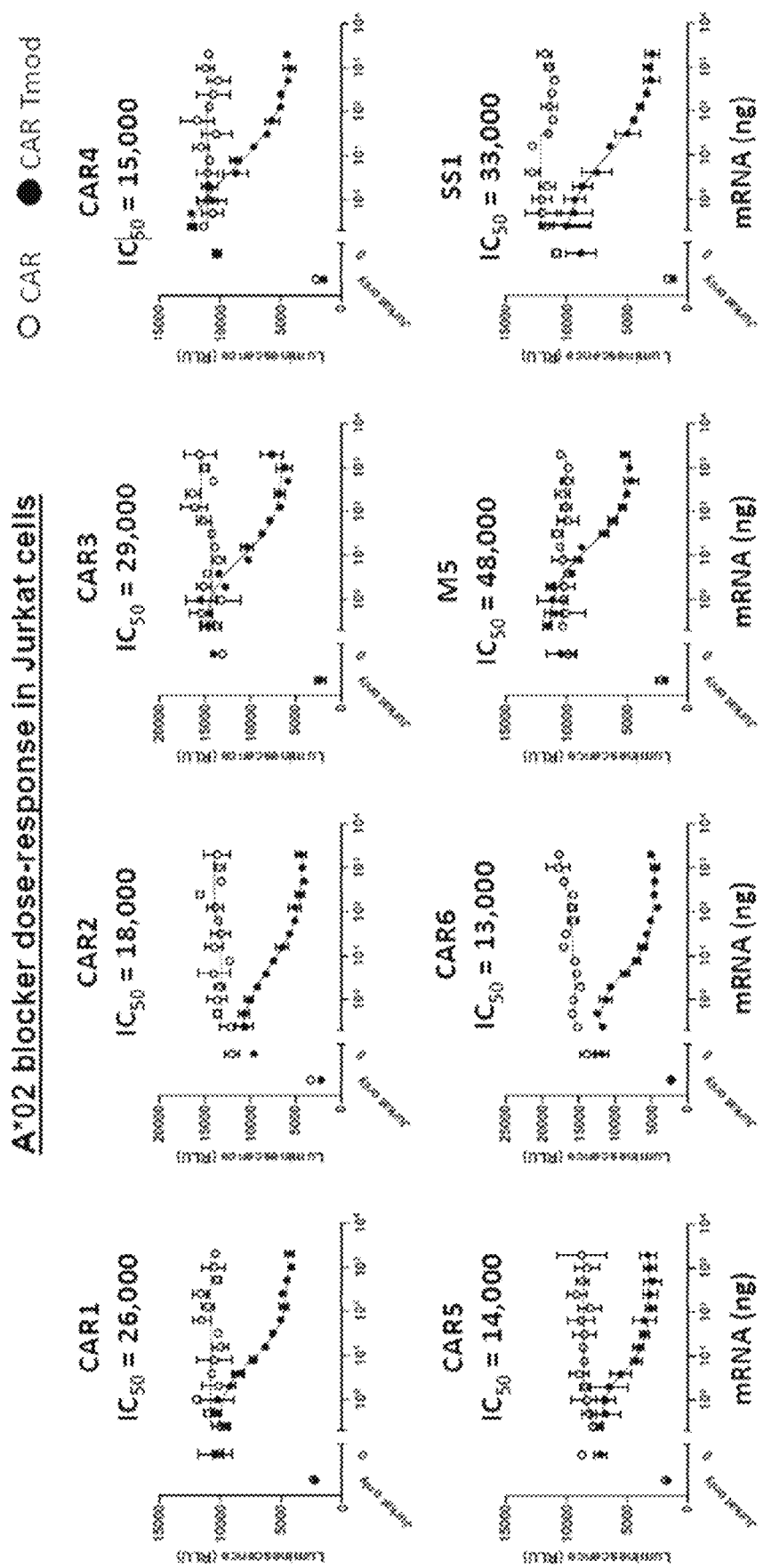
FIG. 27A shows the characterization of MSLN CAR Tmod constructs in Jurkat cell functional assays. Six HuTARG-derived MSLN activators (CAR1-6) and benchmark CARs M5 and SS1 activators were paired with A*02 blocker (closed circles) or empty vector control (open circles). Jurkat NFAT luciferase cells expressing the CAR+/- blocker were co-cultured with wild-type, endogenous MSLN(+) HeLa cells transfected with a titration of A*02:01 mRNA. The functional response (RLU) was assessed after a 6 hour co-culture. Titrated antigen molecules on the surface were quantified using the QIFIKIT. IC50 (molecules/cell) values are indicated in the figure. CAR1-6 are Gen3; CAR M5 and SS1 are Gen2.

Previous work suggested that $E_{max}$ is related to surface expression of the receptor and EC50 to its binding and signal transduction properties, especially the LBD [15,16]. The $EC_{50}$ was converted from relative response measured by luminescence in Jurkat cells to absolute molecules/cell using standard curves and QIFIKIT methodology necessary [27]. One of the benchmark CARs (m912) displayed low functional sensitivity, with an $EC_{50}$ estimated at ~80K molecules/cell. The $EC_{50}$s for the other benchmarks and novel CARs ranged downwards of ~6K molecules/cell. Several novel LBDs assayed as CARs in Jurkat cells had EC50s below the limit of detection (<3K molecules/cell). As an indicator of selectivity, CAR3 and the benchmark M5 were tested for responsiveness to a panel of MSLN(+) and (−) cell lines. Both CARs displayed MSLN-specific activation and were inactive against MSLN(−) lines (FIGS. 24B and 25A). MSLN Tmod Constructs are Blocked Efficiently by HLA-A*02 Antigen in Jurkat and Primary T Cells CAR1-6 and the benchmark CARs were tested as components of Tmod constructs where the CARs were paired with an A*02-directed inhibitory receptor or "blocker" previously shown to inhibit functional response in Jurkat and primary T cells [18]. This blocker comprised an A*02-binding scFv fused to the hinge, transmembrane and intracellular domains of the ITIM-containing LIR-1 protein (FIG. 22B). As target cells we used cell lines characterized for MSLN surface expression (FIGS. 25A and 25B, FIGS. 26A and 26B). All the CARs were blocked in a ligand-dependent manner by the A*02-directed LIR-1 blocker (FIG. 27A). Because of the combination of high sensitivity, selectivity and effective functional pairing with the A*02 blocker, CAR3 was selected for further study as the MSLN Tmod lead activator construct.

Figure 27B:
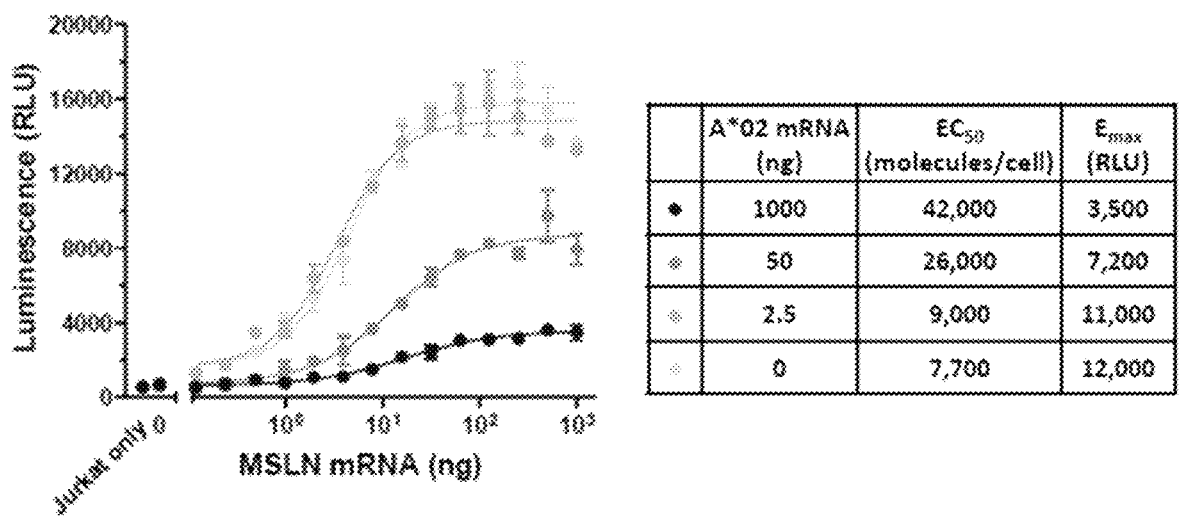
FIG. 27B shows a 2-dimensional titration of MSLN and A*02 mRNA in MSLN(-) HeLa target cells to establish EC50 for the MSLN CAR3 Tmod construct in Jurkat cells. MSLN(-) HeLa target cells were transfected with serially diluted MSLN mRNA and constant A*02 mRNA and Jurkat cells were transiently transfected to express MSLN CAR3 and A*02 blocker. The functional response (RLU) was assessed after a 6 hour co-culture.
Figure 27C:
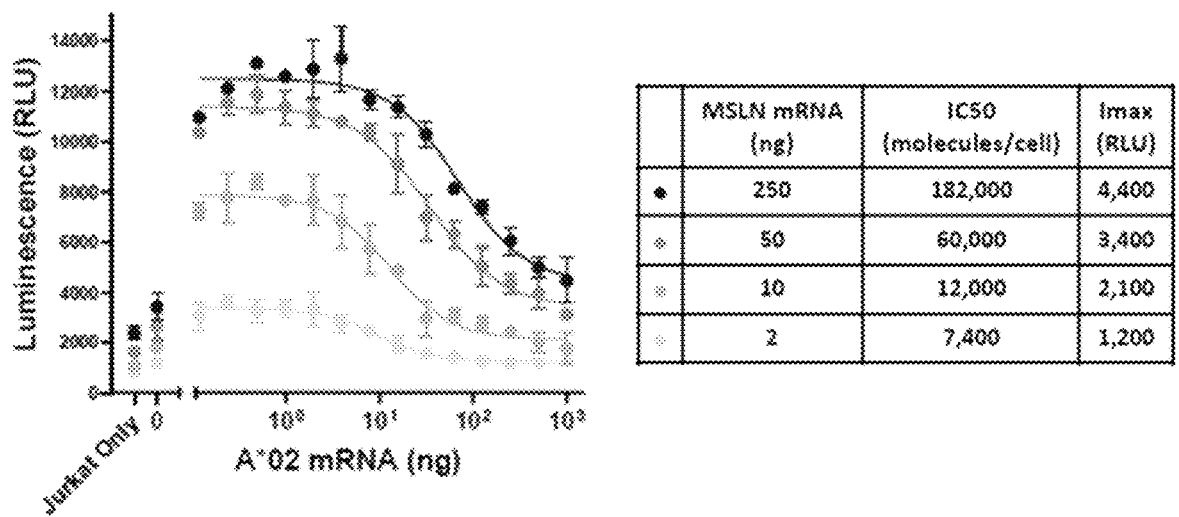
FIG. 27C shows a transfection of MSLN(-) HeLa target cells with serially diluted A*02 mRNA and constant MSLN mRNA to establish IC50 for the MSLN CAR3 Tmod construct in Jurkat cells.
Figure 28A:
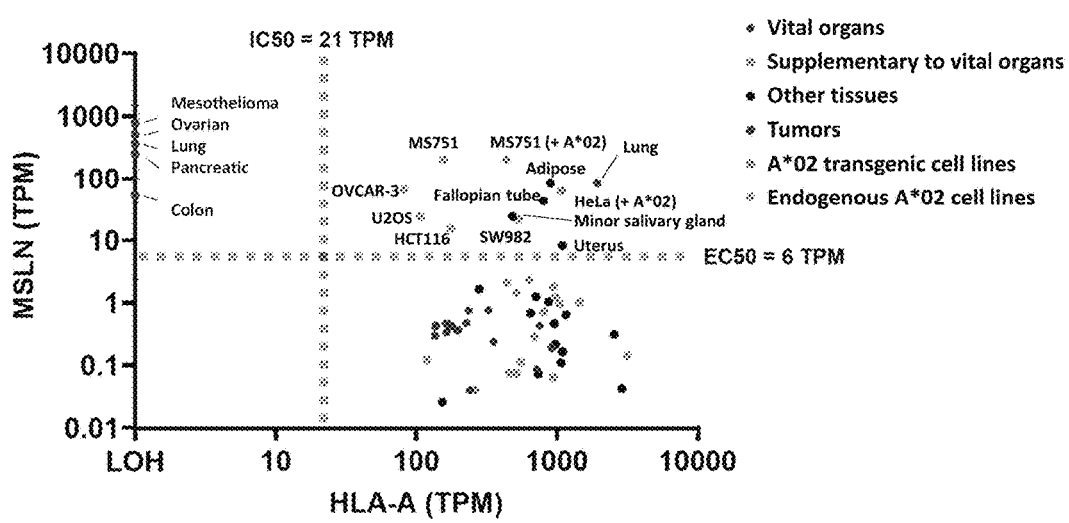
FIG. 28A shows plotted levels of MSLN and A*02 mRNA and protein. EC50 and IC50 of construct in relation to MSLN and HLA-A expression levels in normal (GTEx database) and tumor tissues and cell lines (TCGA, CCLE databases). Conversions between protein and mRNA levels were calculated using the standard curves shown in FIG. 25B; Methods). HeLa and MS751 A*02 transgenic cell line variants shown on the graph better mimic activator and blocker target ratios in normal tissues.

The MSLN CAR3 Tmod construct was examined in detail in a series of quantitative mRNA titration experiments for activation and blocking sensitivity in Jurkat cells (FIGS. 27B and 27C). For target cells, the cervical carcinoma HeLa cell line that, like most other cancer lines, expresses endogenous MSLN was used. This line is HLA-A*02(−). To control MSLN levels, a variant with MSLN inactivated by CRISPR was generated. mRNA titration experiments enabled estimation of EC50 and IC50 for the MSLN CAR3 Tmod construct and these parameters were viewed in the context of the expression levels of antigens on normal and tumor tissues derived from high-quality public databases (FIG. 28A).

Figure 25B:
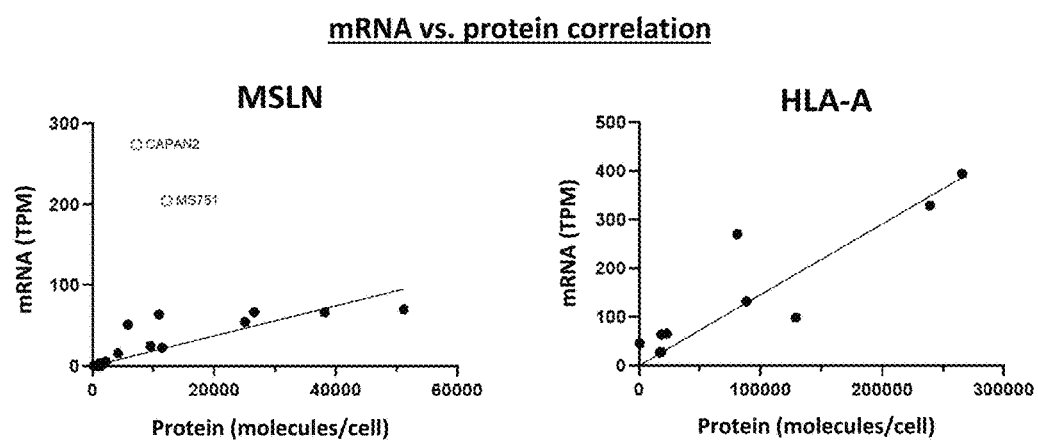
FIG. 25B shows plotted levels of MSLN and A*02 mRNA (CCLE) and protein (QIFIKIT) show correlation. Conversions between protein and mRNA levels were calculated using the standard curves (see Methods for Example 8, infra).

To make these comparisons, a correlation between MSLN mRNA and surface protein levels was established as a first step (FIG. 25B). The same was done for HLA-A and the information used to plot the HLA-A and MSLN levels of different tissues relative to the $EC_{50}$ and $IC_{50}$ of the MSLN Tmod construct. The large majority of normal tissues expressed levels of MSLN well below the $EC_{50}$ of MSLN Tmod. In contrast, certain tissues including lung expressed MSLN at a level well above the $EC_{50}$ of the Tmod construct and, therefore, were considered high risk absent an effective blocker. However, these at-risk tissues also express HLA-A levels above the Tmod $IC_{50}$, suggesting they will be protected against cytotoxicity by the A*02-targeted LIR-1 blocker component of Tmod. The cell lines (including transgenic HLA-A*02 HeLa and MS751) used to model normal and tumor tissues in functional assays are also shown on the graph.

Figure 28B:
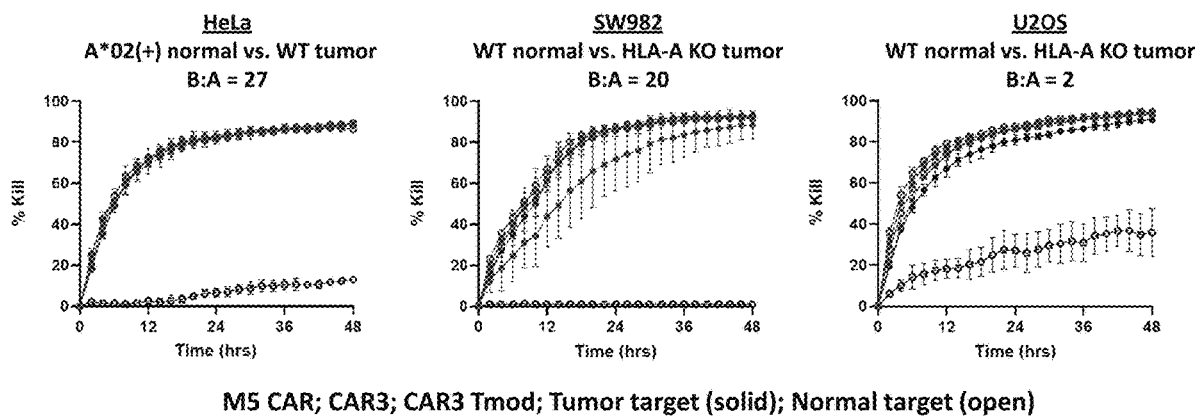
FIG. 28B shows MSLN CARs and CAR3 Tmod cytotoxicity in primary T cells. Primary T cells transduced with CARs or Tmod were co-cultured at an effector:target (E:T)=1:1 for 48 hours with either tumor or normal target cells as shown. A*02:MSLN (B:A) target antigen ratios ranged from 2-27:1. M5 was a Gen2 CAR; all others Gen3. Tumor=MSLN(+)A*02(-) target cells; Normal=MSLN(+) A*02(+) target cells.
Figure 29A:
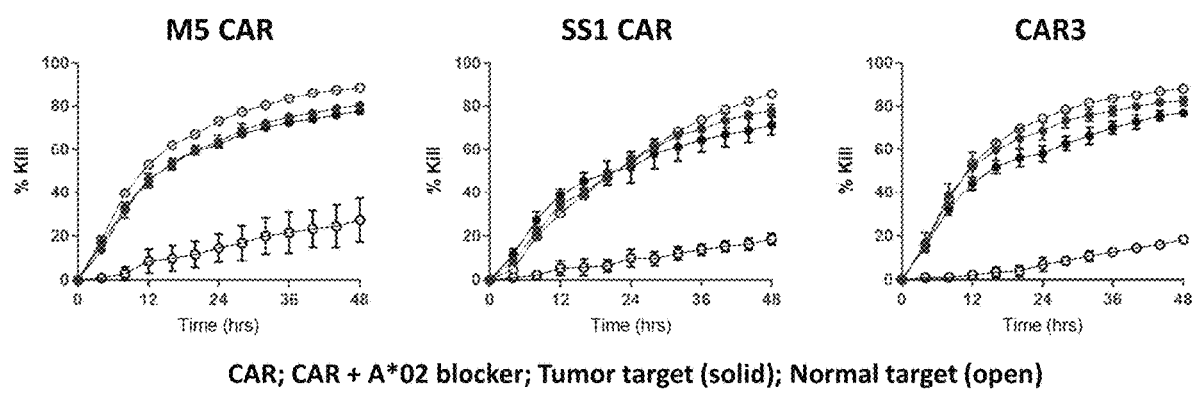
FIG. 29A shows a comparison of lead CAR3 receptor paired with A*02 blocker to benchmark CARs in cytotoxicity assays. SS1 CAR is a Gen2 construct; others are Gen3. Primary T cells transduced with various CARs+/-A*02 blocker using 2 separate lentiviral vectors were cultured with endogenous MSLN(+) A*02(-) tumor or MSLN(+) A*02(+) normal HeLa cells to assess cytotoxicity. Transduced primary T cells were normalized to a constant activator or activator-blocker double-positive population percentage [15% A(+) or A(+)B(+)] cells by dilution with untransduced T cells for a final effective effector:target (E:T) ratios of 0.6:1 or 0.3:1. Both E:T ratios resulted in selective killing in the presence of A*02 antigen when T cells also expressed A*02 blocker.
Figure 29B:
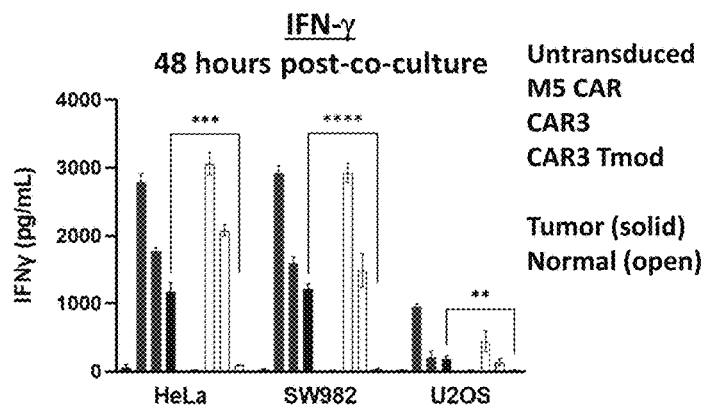
FIG. 29B shows secreted IFN-g after 48-hours of co-culture with tumor or normal target cells.

The behavior of the MSLN CAR3 Tmod construct was then tested in primary T cells. Cytotoxicity was the principal readout, with IFN-γ secretion as a secondary measure. Target cells were HeLa cells and variants: (i) native MSLN(+)A*02(−) HeLa cells modeled tumor cells without blocker antigen; and, (ii) transgenic A*02(+) variant HeLa cells modeled normal mesothelial cells. Combinations of different constructs and target cells demonstrated that all MSLN CAR Tmod constructs kill tumor cells potently and block killing in an A*02-ligand-dependent fashion (FIG. 28B). Two other MSLN CARs from the literature (SS1 and M5) were used for comparison (FIG. 29A). Cytotoxicity was mirrored by IFN-γ release (FIG. 29B). Thus, the Tmod constructs composed of an HLA-A*02− directed blocker and different MSLN CAR activators displayed high potency and specificity for MSLN(+)A*02(−) target cells in both Jurkat and primary T cell assays.

Figure 30A:
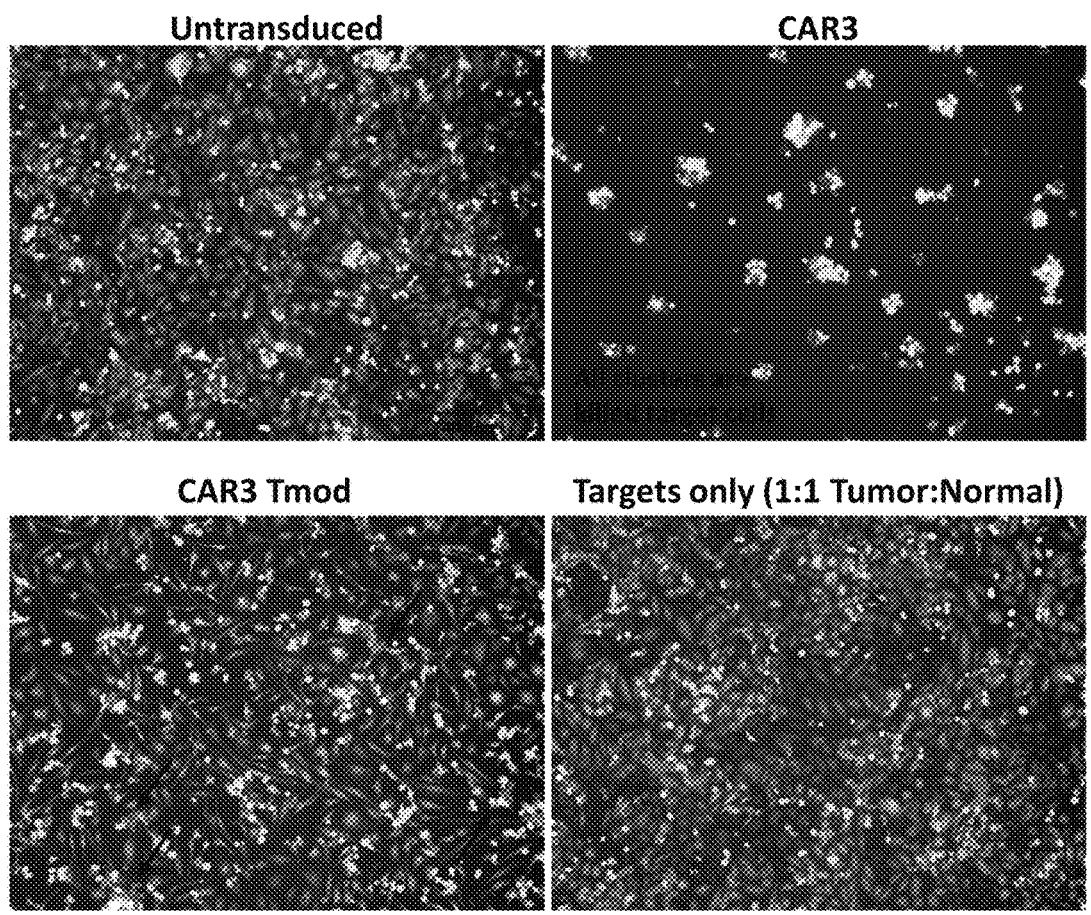
FIG. 30A shows MSLN CAR3 Tmod cells selectively kill RFP(+) tumor cells and spare GFP(+) normal cells in mixed tumor and normal cell co-cultures. Due to the adherent nature of the HeLa cell line, killed targets tend to remain as clusters on the surface. White arrows point to some examples of killed RFP(+) tumor cells. Example of E:T 0.6:1 and normal:tumor=1:1.
Figure 30B:
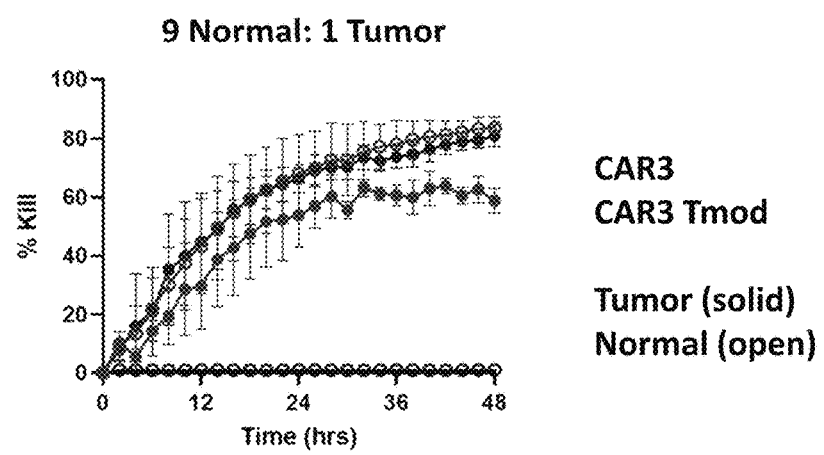
FIG. 30B shows cytotoxicity in mixed normal and tumor co-cultures with E:T=1:1 and normal:tumor=9:1 (see FIG. 31B for other ratios). Primary T cells transduced with CAR3 or CAR3 Tmod construct were co-cultured with HeLa target cells for 48 hours and imaged using GFP and RFP expressed in MSLN(+)A*02(+) normal and MSLN(+)A*02(-) tumor cell lines, respectively.
Figure 31A:
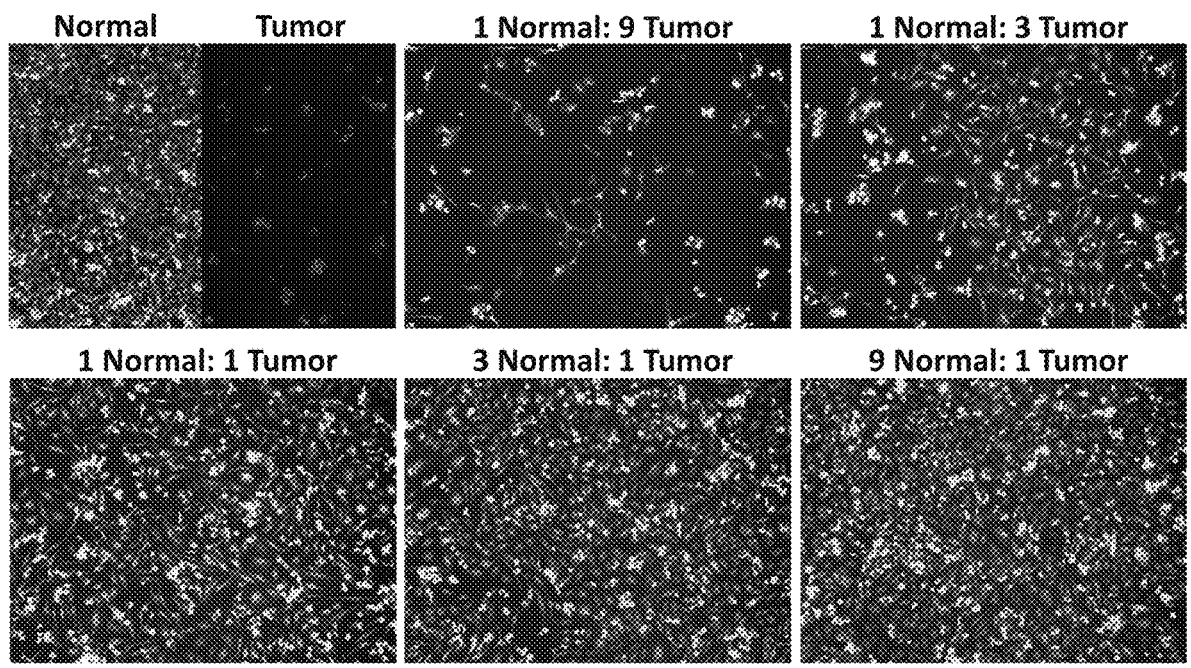
FIG. 31A shows MSLN CAR3 Tmod cells selectively kill RFP(+) tumor cells in mixed tumor and normal cell co-cultures. Primary T cells transduced with CAR3 Tmod construct were co-cultured with HeLa cells for 48 hours and imaged using GFP and RFP expressed in MSLN(+)A*02(+) normal and MSLN(+)A*02(-) tumor cell lines, respectively.
Figure 31B:
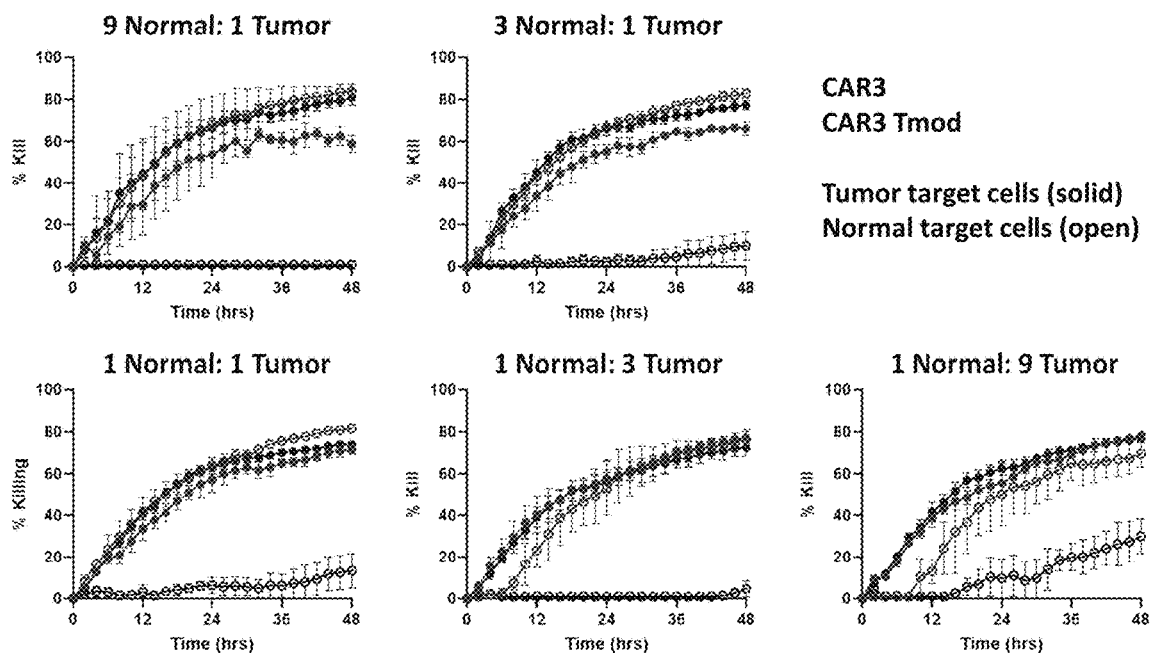
FIG. 31B shows cytotoxicity of CAR3 and CAR3 Tmod in mixed normal and tumor co-cultures with normal:tumor ranging from 9:1 to 1:9; E:T=0.6:1.

The MSLN CAR3 Tmod Construct Mediates Selective, Reversible Cytotoxicity in Mixed-Cell and Serial Cultures A variety of other properties of the MSLN CAR3 Tmod construct important in the context of cancer cell therapy were tested. The construct mediated antigen-selective cytotoxicity in mixed cultures of tumor and normal target cells: Native MSLN(+)HLA-A*02(−) HeLa cells labeled with RFP were mixed at different ratios with MSLN(+)A*02(+) cells labeled with GFP. These cocultures were exposed to T cells engineered with different receptor constructs and imaged. Whereas CAR-only constructs killed indiscriminately, the Tmod constructs killed the native HeLa tumor cells only, leaving the A*02(+) cells unharmed (FIG. 30A). Selectivity was detectable even at normal:tumor cell ratios of 9:1 (FIG. 30B, FIGS. 31A and 31B).

Figure 32A:
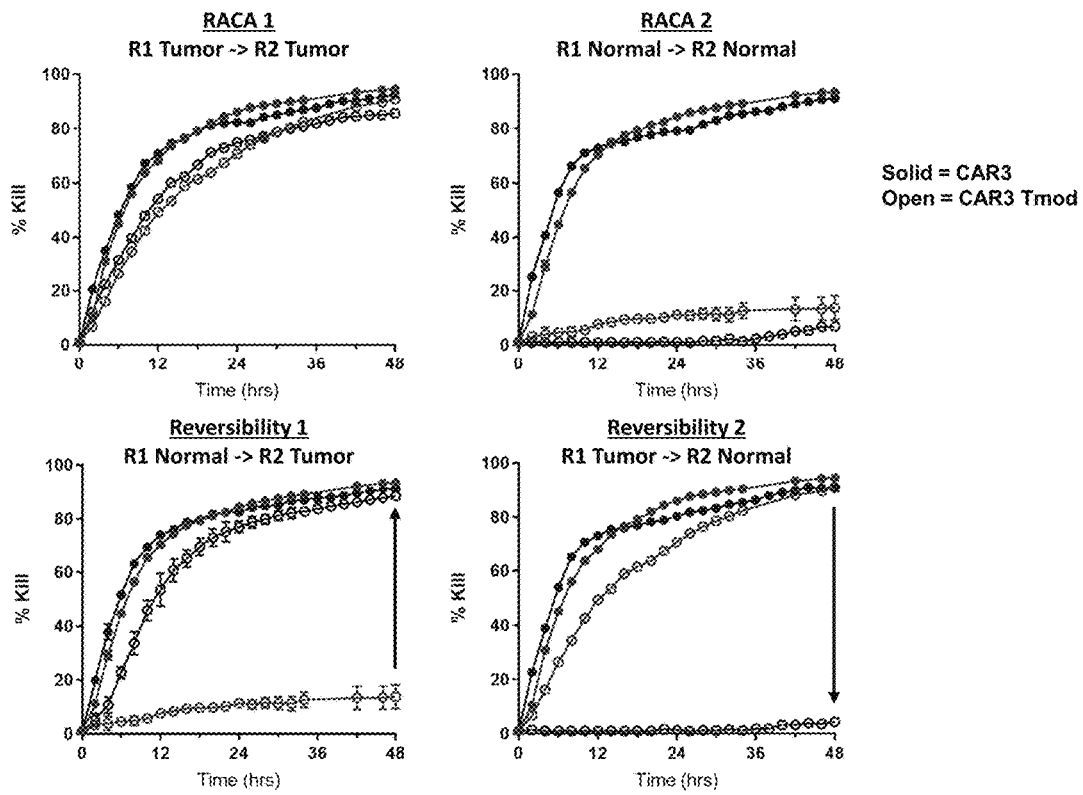
FIG. 32A shows the MSLN CAR3 Tmod construct mediates selective, persistent and reversible cytotoxicity. CAR3 or CAR3 Tmod transduced primary T cells were co-cultured with E:T=1.2:1 for 48 hours with either tumor or normal target cells. T cells were then collected, depleted of dead or nonadherent target cells, and re-seeded onto fresh tumor or normal target cells for an additional 48 hours. RACA, repeat-antigen challenge assay. R1, round 1; R2, round 2.
Figure 33A:
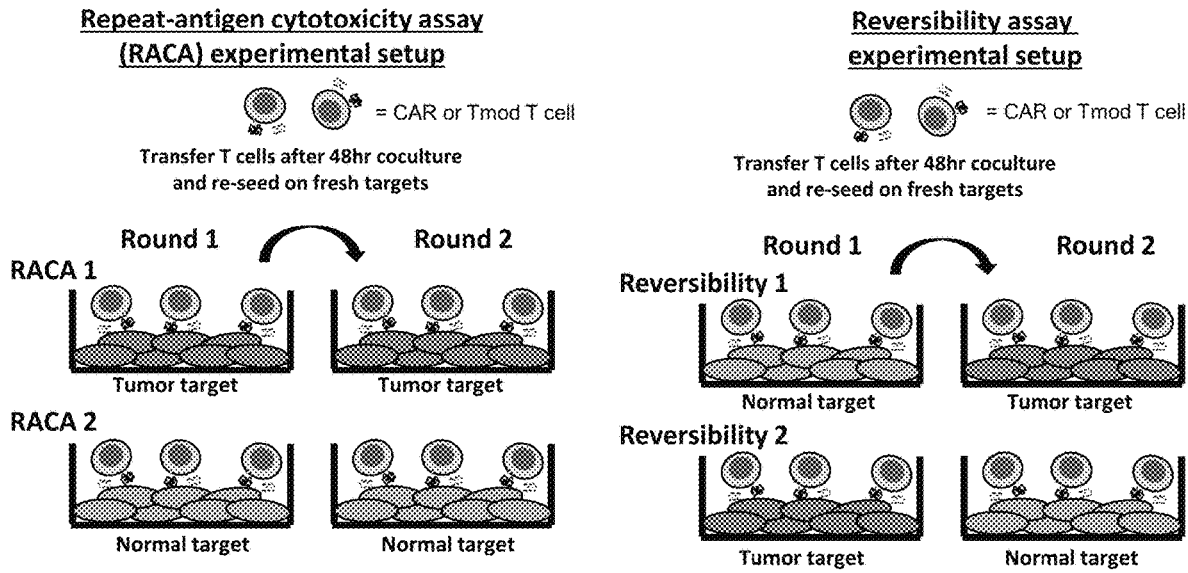
FIG. 33A shows a schematic of RACA (repeat-antigen challenge assay) and reversibility assay. CAR3 or CAR3 Tmod transduced primary T cells were co-cultured with E:T=1.2:1 for 48 hours with either tumor or normal targets. T cells were then collected, depleted of any dead or lifted target cells, and re-seeded onto fresh tumor or normal targets for an additional 48 hours.

The capacity of Tmod cells to switch between ON (active killing) and OFF (blocked) states was examined using cytotoxicity assays as readout. In these experiments the transduced T cells were transferred from one batch of target cells to another (FIG. 32A, FIG. 33A). The Tmod cells displayed the capacity to activate and kill after being exposed for 2 days to normal cells where they were quiescent. The reverse was also true. Tmod cells engaged in killing tumor cells were able to quickly switch to the OFF state and refrain from killing the normal cells after transfer and without a rest period. The ability to switch states was maintained through two cycles, over a total of four days.

Figure 33B:
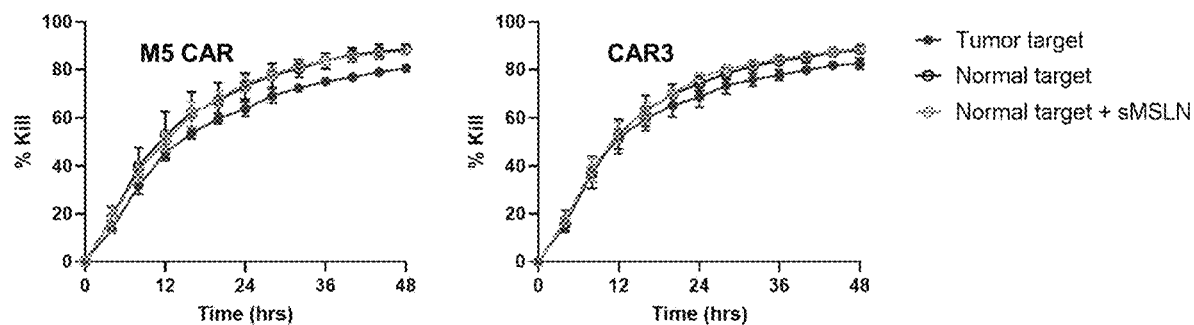
FIG. 33B shows soluble circulating MSLN (sMSLN) does not affect CAR-T activity. Acute cytotoxicity of tumor or normal target cells by M5 benchmark CAR or CAR3 were not affected by the presence of 500 ng/mL sMSLN (Acro Bio).
Figure 33C:
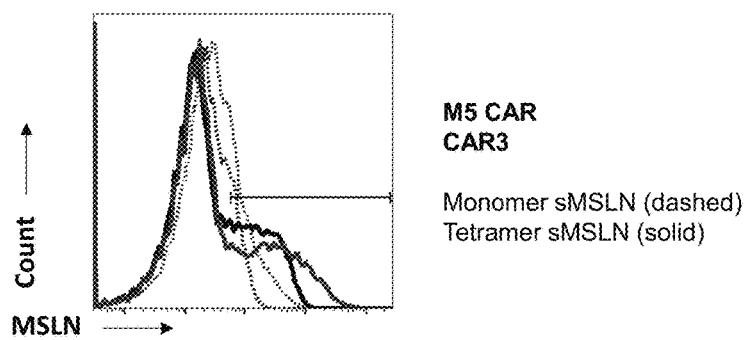
FIG. 33C shows the staining of transiently-transfected CAR(+) Jurkat cells with labeled sMSLN monomer or tetramer analyzed by flow cytometry shows that the sMSLN is structurally intact and able to bind the receptors.

It was investigated whether soluble MSLN (sMSLN), which is present in the blood of some cancer patients at high levels (median ~200 ng/ml; range 20-2,000 ng/ml [19]), interfered with MSLN CAR3 Tmod cells. sMSLN added to the cultures at 500 ng/ml had no effect on function of either the CAR or Tmod T cells FIGS. 33B and 33C). Together, these results suggested that MSLN CAR3 Tmod mediates selective, reversible cytotoxicity in mixed cultures of tumor and normal cells and is unaffected by sMSLN at levels observed in some cancer patients' blood. All of these features are consistent with a cell therapy that has the potential to be safe and efficacious in selected cancer patients.

MSLN CAR3 Tmod Cells Display No Detectable Off-Target Activity

Figure 32B:
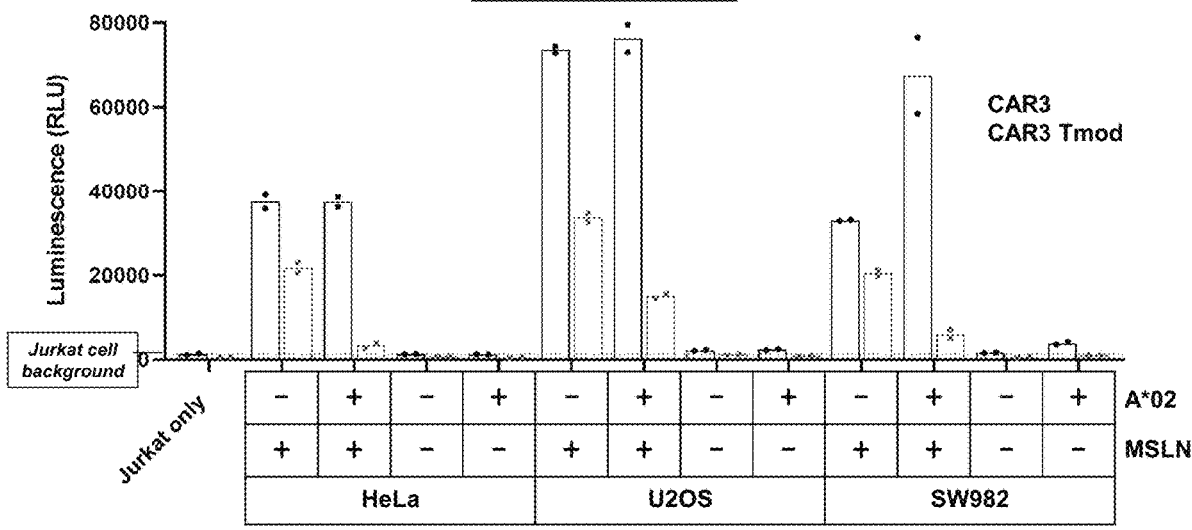
FIG. 32B shows MSLN CAR3 Tmod construct selectivity in a Jurkat cell functional assay on a subset of MSLN(+) and MSLN(-) control target cells showed no off-target activity (see Methods for Example 8, infra). Bar height corresponds to the average from technical replicates.

To systematically explore off-target reactivity of MSLN CAR3 Tmod cells, Jurkat cell activation was tested by a panel of target cell lines chosen to encompass the large majority of adult gene expression (Wang et al., in preparation; see Methods). Positive controls were used to confirm that effector cells could be activated by MSLN(+) cell lines, and negative controls were used to set a baseline for response (FIG. 26B; FIG. 32B). No detectable responses were triggered in CAR3 Tmod Jurkat cells, despite high sensitivity of the assay, estimated at ~1,000 molecules/cell.

The MSLN CAR3 Tmod Construct Mediates Selective Killing of Tumor Cells in a Xenograft Model To examine behavior of MSLN CAR3 Tmod cells in vivo, a mouse xenograft model was used. HeLa cells did not grow well in the immunocompromised (NSG) mice, so another cervical cancer cell line, MS751, was developed as grafted target cells. The native MSLN was used as the activator antigen and the blocker antigen HLA-A*02 was engineered by gene transfer to better approximate normal tissue levels. MSLN(+)A*02(−) MS751 cells, generated by CRISPR knockout of HLA-A*02, modeled tumor while the MSLN (+)A*02(+) transgenic variant modeled normal cells in these in vivo experiments.

Figure 34A:
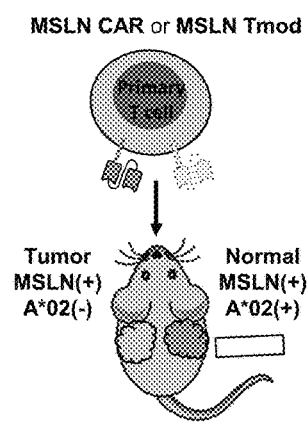
FIG. 34A, FIG. 34B, and FIG. 34C show the Tmod construct mediates selective killing of tumor cells in a xenograft model.
Figure 34B:
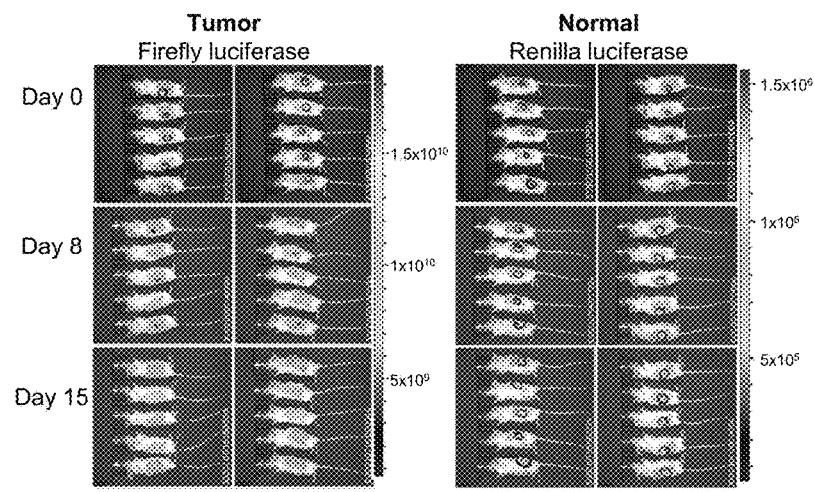
Figure 34C:
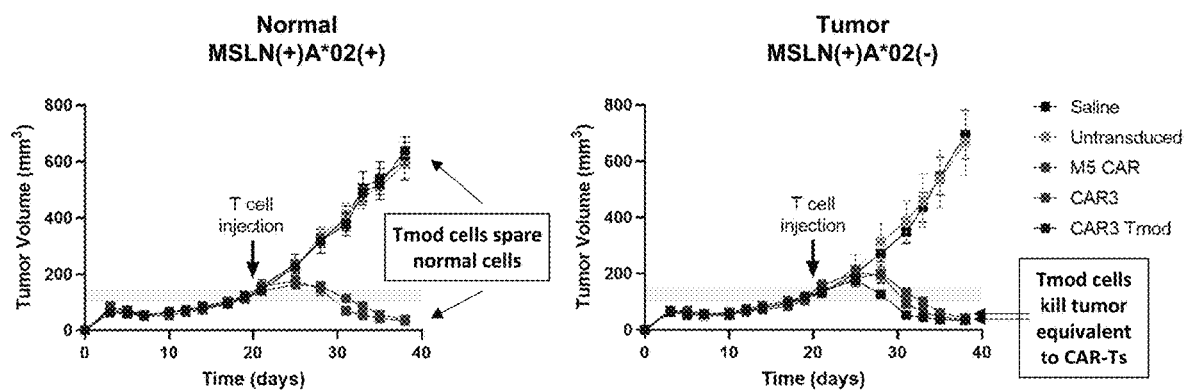
Figure 35A:
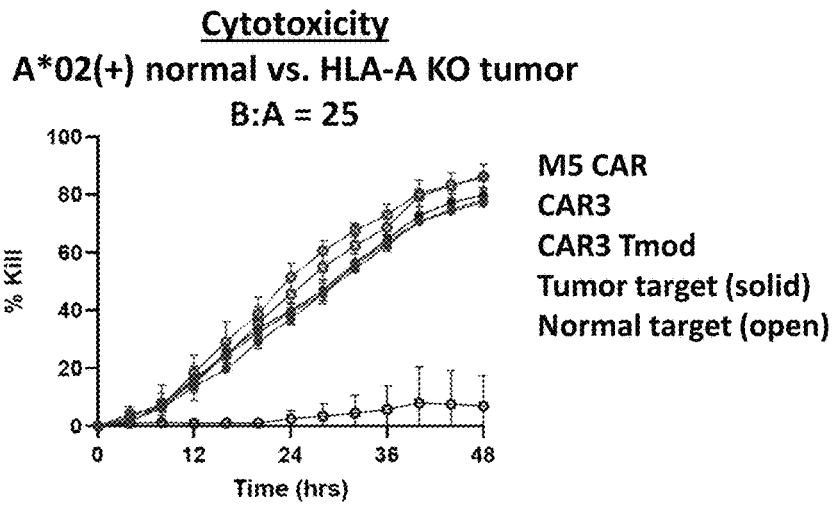
FIG. 35A, FIG. 35B, and FIG. 35C show MSLN CAR Tmod selectively kill tumors in xenograft model
Figure 35B:
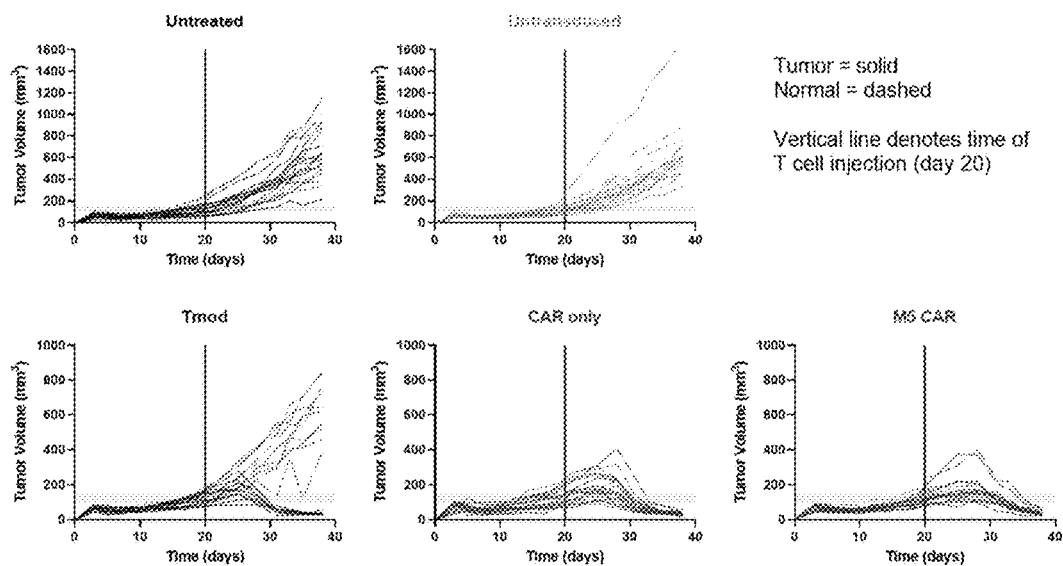
Figure 35C:
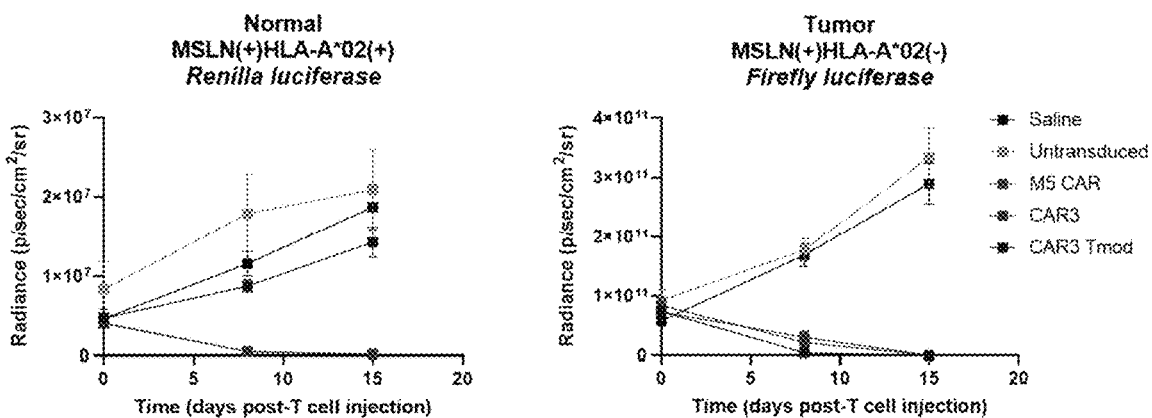

The cell lines were engineered with luciferase to enable bioluminescence as an independent readout of tumor survival and growth. Mice (10/cohort) were implanted with tumor cells on their left flank and normal cells on their right flank in half of the mice in each cohort, and vice versa in the other half to control for flank growth variation (FIG. 34A). After xenografts reached ~100-150 mm$^3$ in volume, mice were infused via tail vein with 2E7 total T cells/mouse. After a short delay, both the CARs and the Tmod constructs killed the MSLN(+)A*02(−) tumor cells equally well measured by caliper and bioluminescence intensity (FIGS. 34B and 34C, FIGS. 35B and 35C). Whereas the CAR-only T cells killed both tumor and normal with equal effectiveness, Tmod cells killed only the tumor grafts, mirroring in vitro cytotoxicity (FIG. 14A). In the presence of Tmod cells, the normal cell grafts grew comparably to those in the control groups treated with untransduced T cells or saline. These results dramatically demonstrated selectivity of the MSLN Tmod system in a mammalian body, consistent with other activator-blocker pairs which have been observed (Sandberg et al., submitted; [18]).

Extension of the MSLN CAR Tmod Platform

Figure 36:
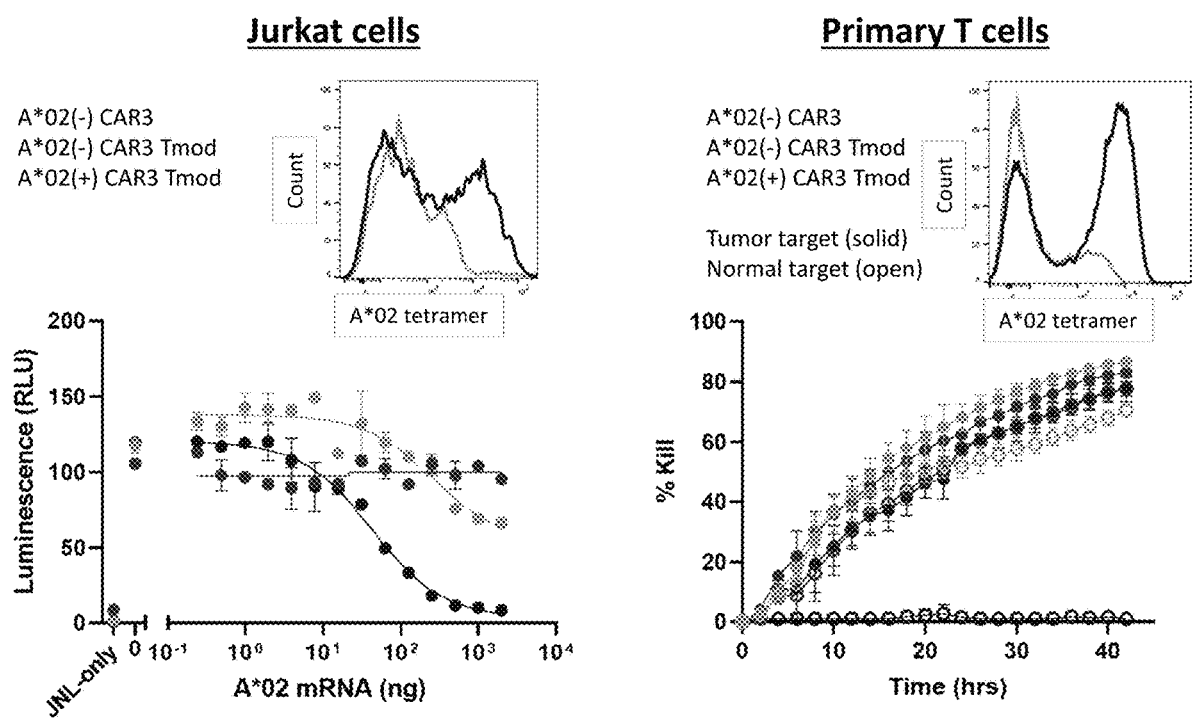
FIG. 36 shows cis binding of A*02 blocker in A*02(+) or (−) T cells abrogates function. Binding of the blocker in A*02(+) Jurkat cells and primary T cells by A*02 tetramer was significantly reduced due to cis-binding of autologous A*02. Reduced binding (due to reduced availability of the blocker) correlated with reduced blocker activity. Cytotoxicity assay shown at an E:T=0.5:1.
Figure 37A:
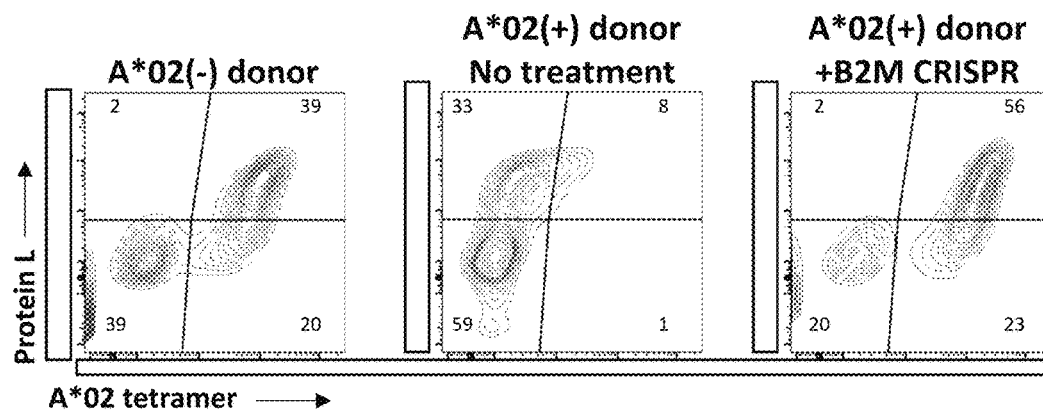
FIG. 37A, FIG. 37B, and FIG. 37C show the MSLN Tmod system can be extended to autologous T cells.
Figure 37B:
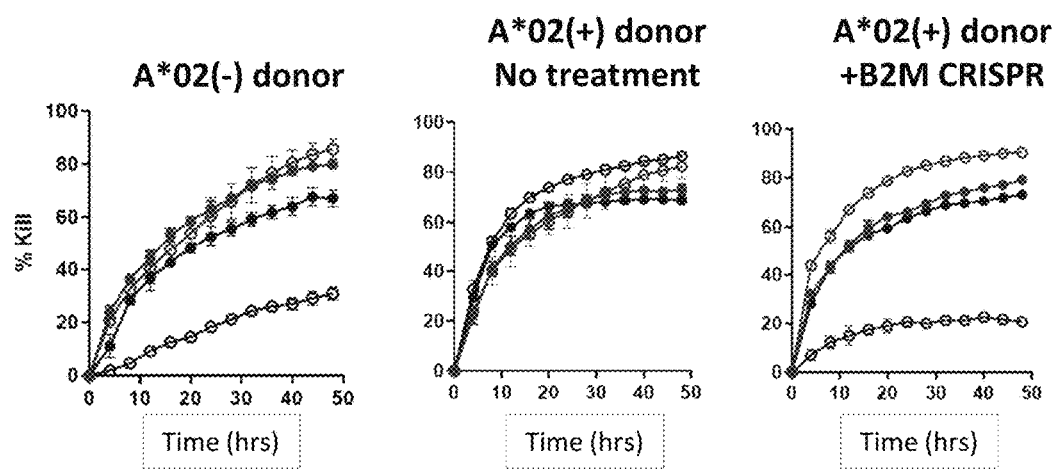
Figure 37C:
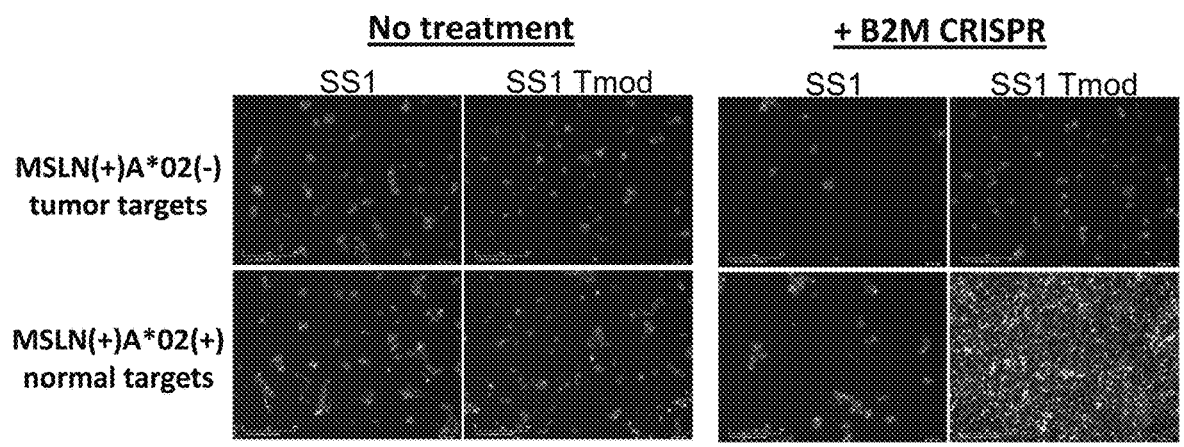

Use of an HLA-A*02- targeted blocker raises the possibility that the blocker may be bound in cis by endogenous HLA-A*02 molecules produced in autologous T cells. Indeed, decreased blocker binding was observed with HLA-A*02 tetramer in transfected transgenic A*02(+) Jurkat cells compared to native Jurkat A*02(−) cells (FIG. 36). A similar decrease was observed in primary T cells from HLA-A*02(+) donors transduced with MSLN CAR3 Tmod or SS1 Tmod constructs compared to A*02(−) donor T cells (FIG. 36, FIG. 37A). More importantly, this decreased binding translated to poor blocker function in both A*02(+) Jurkat and primary T cells relative to their A*02(−) counterparts (FIG. 36, FIGS. 37B and 37C). These observations illustrated how cis-binding may pose a problem for an autologous MSLN CAR3 Tmod product that utilizes an A*02-directed blocker.

To address this problem, we developed a solution based on CRISPR inactivation of endogenous β2 microglobulin (B2M). Because B2M is required for all HLA class I expression, this approach was expected to mitigate the cis-binding effect of HLA-A*02. As predicted, knockout of B2M in primary T cells restored blocker binding and function to levels comparable to A*02(−) donor T cells (FIGS. 37A-37C). Thus, CRISPR-mediated abrogation of cis-binding produced MSLN Tmod cells with functional properties in HLA-A*02(+) donors that were indistinguishable from function in HLA-A*02(−) donors. These results suggest that the MSLN CAR3 Tmod construct may be suitable for allogeneic cell therapy and autologous products, provided that a method is employed to reduce expression of A*02 in the patient's T cells.

The MSLN CAR3 can be Paired with an HLA-A*11- Directed Blocker

Figure 38A:
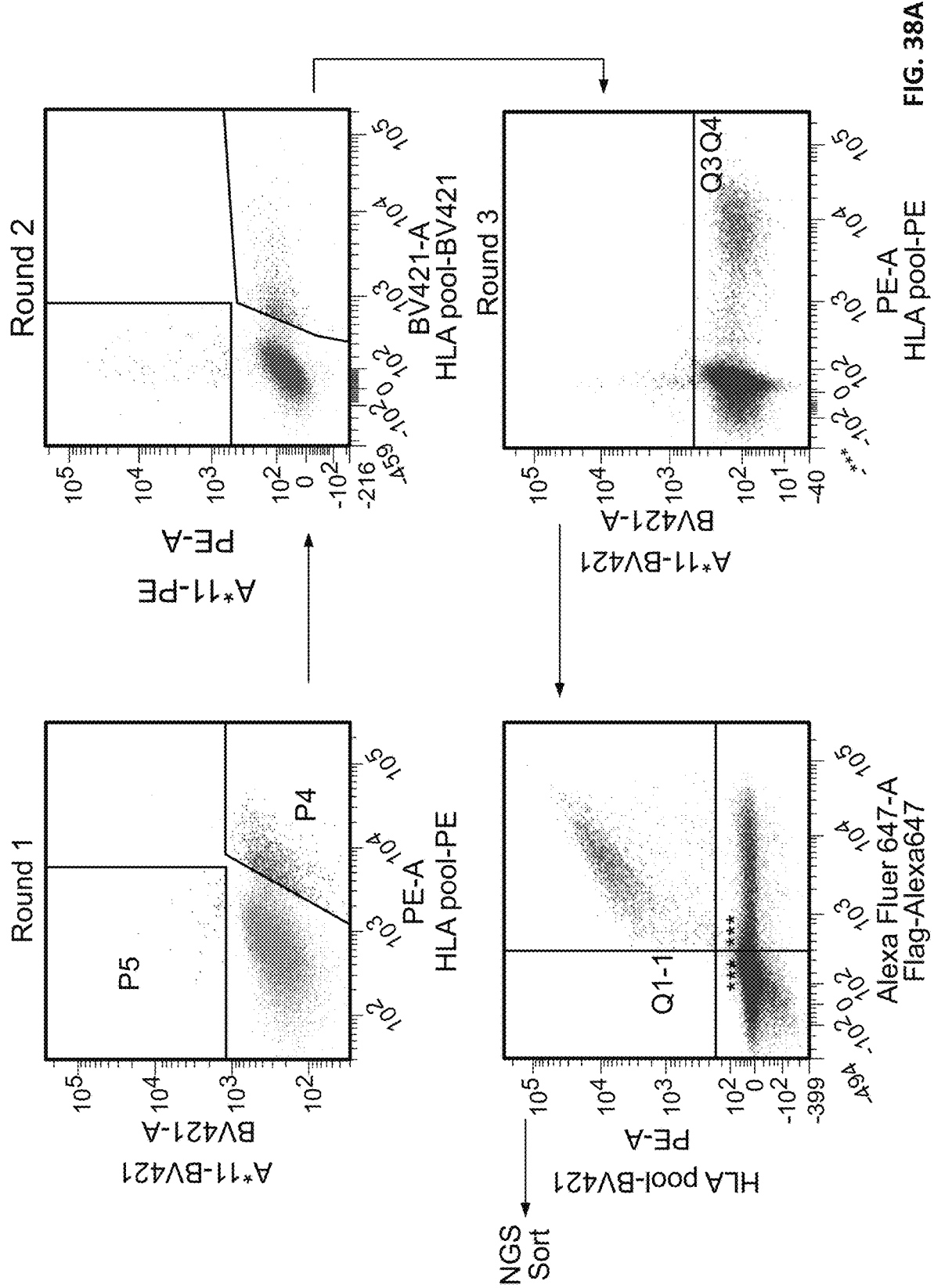
FIG. 38A shows enrichment of anti-HLA-A*11 binders through multiple rounds of cell sorting from scFv library. On-target probe was labeled HLA-A*11 tetramer; off-target proteins were a mixture of unrelated MHC tetramers.

The impressive performance of the MSLN CAR3 Tmod construct that utilizes an A*02-directed blocker suggested the possibility that CAR3 might be paired with blockers gated by other HLA class I alleles. If true, this would potentially allow the Tmod platform to be used to treat patients who are not heterozygous for HLA-A*02—a number estimated at >60% of the population [20]. For proof of concept of the modularity of the MSLN Tmod system, HLA-A*11, the most common class I allele in Asian populations was studied [20]. A screen for A*11-selective scFvs was carried out using the same method described for isolation of MSLN scFvs (see Methods, infra). A series of enrichment steps using the mammalian scFv-display library generated several A*11-specific scFvs (FIG. 38A).

Figure 38B:
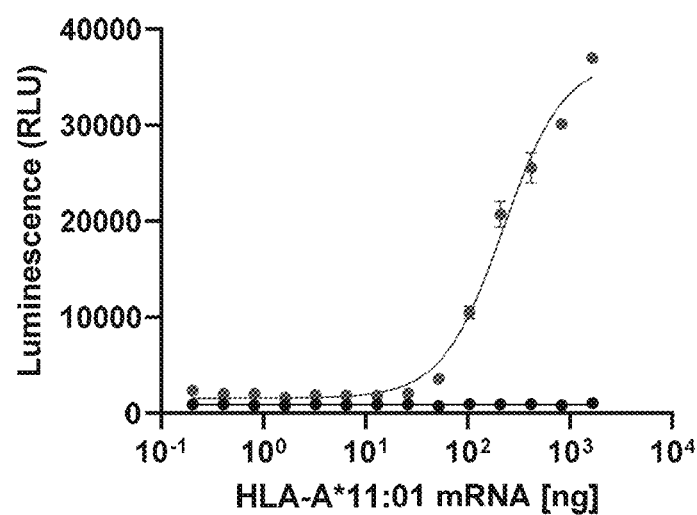
FIG. 38B shows Jurkat cell activation in an mRNA titration assay: HeLa target cells were transfected with serially diluted HLA-A*11 mRNA and Jurkat cells were transiently transfected to express HLA-A*11 CAR4. The functional response (RLU) was assessed after a 6 hour co-culture. PE, phycoerythrin.
Figure 39A:
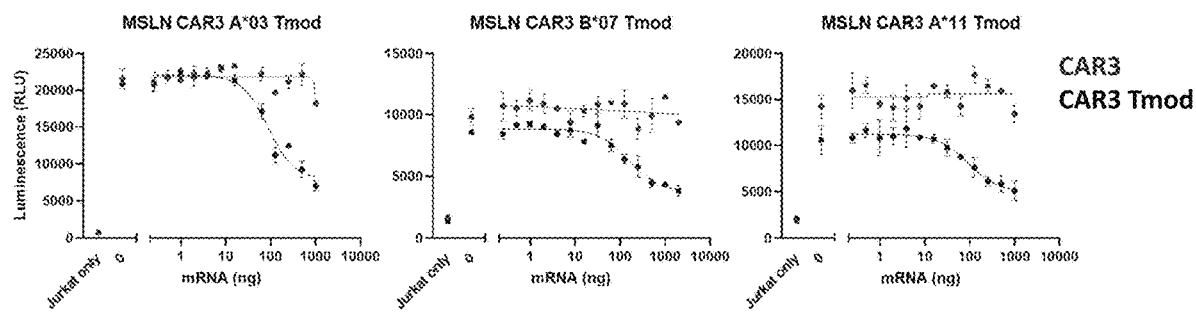
FIG. 39A shows Jurkat cells expressing MSLN CAR3 and A*03, A*11 or B*07 blocker constructs were blocked in the presence of increasing blocker antigen on endogenous MSLN(+) HeLa target cells.
Figure 39B:
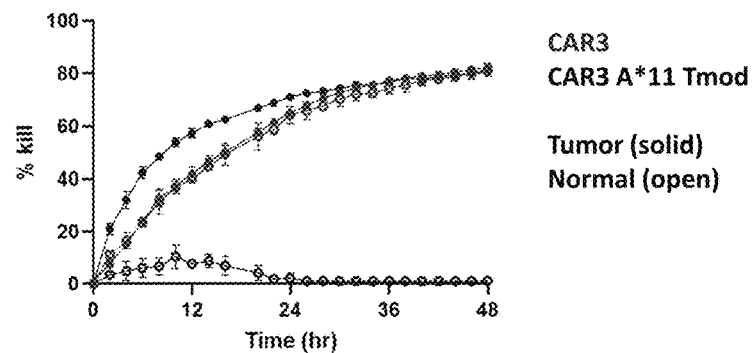
FIG. 39B and FIG. 39C show primary T cell cytotoxicity assay of MSLN CAR3+A*11 blocker. Primary T cells transduced with CAR3 and A*11:01-directed blocker efficiently blocks HeLa target cells with A*11:01 and kills wildtype HeLa cells as effectively as CAR-only cells. Transduced primary T cells were co-cultured with HeLa cells with or without HLA-A*11:01 at an E:T=0.8:1. Note that both tumor and normal target cells used here expressed GFP.
Figure 39C:
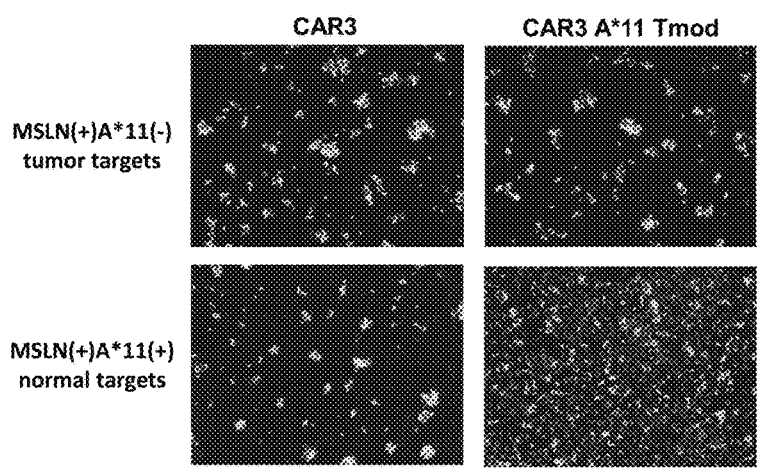

One high-performing scFv (A*11-LBD4) was fused to LIR-1 and paired with the MSLN CAR3 activator in Jurkat cells. This A*11 blocker demonstrated good function with an IC$_{50}$ estimated at 37,000 molecules/cell from mRNA titration experiments (FIG. 38B). Finally, the MSLN CAR3 paired with the A*11 blocker was confirmed to function well in Jurkat cell and primary T cells with potency and blockade comparable to the MSLN CAR3 Tmod construct that utilizes HLA-A*02 as blocker antigen (FIGS. 39A-39C). Encouraged by these results we converted two other anti-HLA-I monoclonal antibodies, targeting A*03 and B*07, to scFvs and tested them as MSLN Tmod blockers (FIG. 39A). These findings suggest that the Tmod system is sufficiently modular to accommodate pairings of one activator with multiple blockers, thereby extending the accessibility of the cell therapy platform to a larger number of patients.

Discussion

Given the distribution of MSLN in the adult body [1, 2, 4], it is vital that the blocker functions well with a MSLN-targeted activator. The properties of the A*02 blocker described here suggest it will inhibit activation signals that arise from the CAR across a broad range of MSLN antigen levels. It is also likely that the blocker will inhibit other sources of T cell activation triggered by the CAR, including off-target. Because the HLA blocker antigen is ubiquitously expressed in nucleated cells, it should provide an inhibitory signal under all circumstances except when the blocker antigen is absent as in tumors selected for LOH. The blocker may also prevent cytokine-release syndrome, a continuing source of toxicity observed for T cell therapies [14, 33], if the stimulus involves normal cells or cell fragments.

The MSLN therapeutic candidate described here requires selection of patients who are germline heterozygous for the blocker-antigen allele and whose tumors have lost this allele via LOH. Fortunately, such diagnostic tests have been developed recently which utilize the enormous power of DNA sequencing technology [27-29]. DNA-sequence-based LOH detection has sufficient sensitivity to distinguish most cases of clonal vs. subclonal LOH in the tumor, thereby enriching for patients most likely to benefit from the therapy. Because this diagnostic method utilizes genome sequence from the tumor, it detects any allelic variation and is not restricted to HLA-A*02. The lead MSLN Tmod construct described here is applicable to a subset of HLA-A*02(+) patients. With the goal of extending the Tmod platform to other patients, we have shown that the MSLN CAR3 activator can be paired with blockers directed at 3 other HLA-I allelic products including HLA-A*11. A*11 is the most frequent HLA-I allele in most Asian populations and represents a significant opportunity for benefit in parts of the world beyond the US. Indeed, with a collection of blockers directed at 6-8 of the most common HLA-I alleles in the world, it should be possible to cover the large majority of solid tumors that harbor LOH at the HLA locus—estimated to be >15% of solid-tumor mortality at present [22, 30]. In addition we have shown in a parallel line of work that the HLA-A*02 blocker can be paired effectively with other activators including a CAR directed at another well-known tumor-associated antigen, CEA (Sandberg et al., in preparation; 31).

The modular Tmod system leverages the capacity of cells—unique among therapeutic modalities—to integrate multiple signals into a coordinated response and thus offers a means to address the fundamental obstacles of solid-tumor therapy [18, 21, 22]. Therapeutics must access the tumor and overcome barriers that do not exist for blood cancers where cell therapies have proven effective [23]. T cells have an advantage over most other modalities, including antibodies, in that they possess a natural mechanism for active extravasation and biodistribution (see for review Mastrogiovanni et al. [24]). Furthermore, the Tmod approach described here that exploits LOH mitigates the key constraint on solid-tumor therapeutics posed by normal tissue expression of most targets. Though notoriously non-homogeneous, a large proportion of genetic alterations arise in the founding cell of the neoplasm and are present in all its descendants [25]. Such homogeneous mutations include LOH and, if such clonal LOH can be distinguished via a diagnostic test from later alterations present in tumors, LOH heterogeneity at the HLA locus should not constitute a source of resistance [26]. Unlike single nucleotide substitutions that generate most neoantigens, LOH is an irreversible event and should be stable even after strong selective pressure is applied via therapy. Finally, as use of checkpoint inhibitors becomes more prevalent, rates of HLA-I loss will likely increase, further expanding the pool of patients who may benefit from MSLN Tmod therapeutics [34].

Materials and Methods

Cell Line Culture

Cell lines were purchased from ATCC (American Type Culture Collection) and handled according to manufacturer's instructions: T2, Shp77, Raji, MS751, A-375, A-498, SW982, SW480, HeLa, NIH-OVCAR-3, HepG2, NCI-H508, LNCaP clone FGC, K562, U2OS, BB7.1 and GAP A3 hybridomas. Jurkat cells encoding an NFAT luciferase reporter gene were obtained from BPS Bioscience and maintained in RPMI supplemented with 10% heat-inactivated (HIA) FBS (inactivated at 56° C. for 1 h), 1% penicillin and streptomycin (pen/strep), and 0.4 mg/ml Geneticin. Human peripheral blood mononuclear cells (PBMCs) were obtained from Stem Cell Technologies and thawed in X-VIVO 15 (Lonza) supplemented with 5% HIA human AB serum and activated with T Cell TransAct (Miltenyi Biotec) as recommended by manufacturer. Lentiviral transductions of CAR or CAR Tmod single vector constructs (see FIG. 1b, unless otherwise noted) were done at 24 h post-activation and cultures were maintained in LymphoONE T cell Expansion Medium (Takara Bio) supplemented with 1% HIA human AB serum and 300 IU/mL IL-2.

Molecular Cloning and mRNA In Vitro Transcription

Activating and blocking CAR constructs were designed and constructed as previously described[9]. Briefly, activating CARs were created by fusing the anti-MSLN scFv LBDs to the CD8α hinge, CD28 transmembrane (TM), and CD28, 4-1BB and CD3ζ intracellular domains (ICD). Blocking CARs were generated by fusing the anti-HLA-A*02, A*03 or B*07 scFv LBDs derived from monoclonal antibodies PA2.1 [32], GAP A3 [36] or BB7.1 [37], respectively, to the hinge, TM and ICD domains of LIR-1. Gene segments were combined using Golden Gate cloning and inserted downstream of a human EF1α promoter in a lentiviral expression vector.

For messenger RNA (mRNA) preparation, PCR was used to generate the DNA template used for in vitro synthesis mRNA. Briefly, T7 promoter was introduced via N-terminal primer and common overhang regions were used for both N- and C-terminal primers. The PCR product was used as a template for in vitro transcription (IVT) using the T7 ARCA mRNA kit (New England Biolabs, E2060S). The IVT reaction comprised 1× ARCA/NTP mix, 1.25 mM Ψ-UTP (TriLink), 25 ug PCR product template, and 1× T7 RNA polymerase. The IVT reaction was incubated at 37° C. for 2 h, then 2 uL of DNase I (New England Biolabs, M0303S) was added to each reaction and incubated at 37° C. for 15 min. To the IVT reaction, 65 uL water, 10 uL 10× poly-adenylation reaction buffer (NEB M0276S) and 5 uL of poly-adenylation enzyme (NEB M0276S) was added to a total volume of ~100 uL. The reaction was incubated at 37° C. for 30 min. The resulting product was cleaned using the Monarch RNA cleanup kit (T2040L) according to the manufacturer's protocol.

MSLN and HLA-A*11 Binder Generation Using Mammalian Display

Binder generation using the HuTARG mammalian display technology has been previously described (U.S. Pat. No. 8,012,714 B2; Wang et al., in press). For the MSLN binder generation, soluble MSLN (catalog #MSN-H82E9) and irrelevant, off-target proteins, EGFR and CEA, were purchased from Acro Biosystems. The HuTARG library was subjected to serial rounds of on-target enrichment and off-target depletion using fluorescence-activated cell sorting (FACS). The HLA-A*11 binder generation campaign was similarly conducted. The HuTARG library was subjected to on-target enrichment using HLA-A*11:01 tetramer and off-target depletion using a pool of 4 unrelated HLA class I tetramers. In the final round of both campaigns, on- and off-target binding cells were collected, and RNA was reverse transcribed into cDNA. Fragments containing the complementarity determining regions (CDRs) were amplified using polymerase chain reaction (PCR) and sequenced by next-generation sequencing (NGS). Binders of interest were selected by comparing the input and output NGS counts.

MSLN Surface Quantification

To quantify surface mesothelin molecules, adherent cells were first washed once with DPBS then once with Versene. Cells were coated with Versene and incubated at 37° C. for ~15 min. After incubation, flasks were tapped vigorously to promote complete detachment. The cells were then diluted with DBPS at 1:2 ratio (Versene:DPBS) and counted. 300,000 cells were centrifuged at 500×g for 5 min. Cells were resuspended in 300 uL 1×FACS buffer (DPBS+1% BSA). 100 uL of aliquot was divided into 2 v-bottom wells. Cells were washed one more time with 100 uL FACS buffer, then stained with 100 uL of anti-MSLN antibody at 10 ug/mL (R&D Systems, clone 618923) on ice for 30 min. After the primary stain, 50 uL of calibration beads from the QIFIKIT (Agilent) were added for washing. The mixture was washed with 100 uL FACS buffer twice, then stained with 100 uL of anti-mouse F(ab')2-Goat Alexa Fluor 647 (Invitrogen) antibody diluted 2000× in FACS buffer for 45 min on ice. The stained cells and beads were washed 2× with 100 uL FACS buffer, then resuspended in 100 uL FACS buffer to measure fluorescence. The calibration curve plotting median fluorescence intensity of each bead population vs. number of molecules was plotted according to manufacturer's protocol provided by the QIFIKIT (Agilent). The number of endogenous MSLN molecules was determined by fitting the cell's median fluorescence intensity onto the calibration curve generated with the QIFIKIT beads.

MSLN Activator and Various Blocker Sensitivity Determination

To determine activator or blocker sensitivities, antigen was titrated into antigen(−) cell lines at various concentrations. Flow cytometry and QIFIKIT methodology [17] using standard curves could then be used to calculate absolute molecules/cell. The $EC_{50}$ or $IC_{50}$ value of activators or blockers, respectively, expressed in Jurkat cells was then measured by luminescence. Specifically, HEK293T or HeLa cell transfection with antigen mRNA was performed using the 4D nucleofection kit (Lonza). For single-antigen titrations (i.e., MSLN, HLA-A*02, HLA-A*11, HLA-A*03, HLA-B*07), mRNA was diluted to 1000 ng/uL in SE or SF buffer supplemented with Supplement solution (complete buffer) for HEK293T or HeLa cells respectively. The diluted mRNA was serially diluted 2× by adding stock mRNA to equal volumes of complete buffer 13 times, with the 15th well lacking any added mRNA. Target cells were detached from the flask using TrypLE Express (Gibco). Appropriate number of cells were harvested then resuspended in complete buffer at 11.1e6 viable cells/mL. 22.5 uL of resuspended cells were added to 2.5 uL of serially-diluted mRNA to a final volume of 25 uL cell and mRNA mix. 20 uL of this sample was zapped using the 4D nucleofector using the CM-130 program for HEK293T cells or CN-114 program for HeLa cells. The cells were transferred into 280 uL of MEM+10% FBS+0.1% P/S. 15 uL of the diluted cells were transferred into 384-well plate and incubated 18-24 h at 37° C., 5% $CO_2$. The remaining diluted cells were transferred to a 96-well plate and kept for next day analysis of surface antigen expression using the QIFIKIT as described above. In parallel, Jurkat-NFAT luciferase effector cells were transfected with appropriate CAR DNA at 1 ug per 1e6 cells or CAR Tmod DNA (single vector construct, unless otherwise noted) at 4 ug per 1e6 cells using the Neon electroporation system using the following parameters: 1500 V, 10 ms, 3 pulses. Transfected cells were immediately transferred to pre-warmed RPMI supplemented with 20% heat-inactivated (HIA) FBS and 0.1% pen/strep and incubated for 18-24 h at 37° C., 5% $CO_2$. Next, Jurkat cells were counted and resuspended in RPMI+10% HIA FBS and 0.1% pen/strep at 0.67e6 cells per mL. 1e4 resuspended Jurkat cells in 15 uL were then co-cultured with transfected cells in the 384-well plate for 6 h. Luciferase activity was measured using ONE-Step Luciferase Assay System (BPS Bioscience).

For target cell co-transfections including MSLN and HLA-A*02 the protocol above was used except for minor adjustments to the mRNA dilutions step. mRNA encoding HLA-A*02 and MSLN were prepared by Aldevron and TriLink respectively. Briefly, to generate $EC_{50}$ curves, a 14-point 2× serial dilution was performed with MSLN mRNA. This serial dilution was combined with each of four dilutions of various constant amounts of A*02 mRNA so that the top concentration of MSLN mRNA was 500 ng/ul and the A*02 mRNA concentrations were as follows: 500 ng/uL, 25 ng/ul, 1.25 ng/uL, and 0 ng/uL. To generate $IC_{50}$ curves, a 14-point 2× serial dilution was performed with A*02 mRNA. This serial dilution was combined with each of four dilutions of various constant amounts of MSLN mRNA so that the top concentration of A*02 mRNA was 500 ng/uL and the MSLN mRNA concentrations were as follows: 125 ng/uL, 25 ng/ul, 5 ng/uL, and 1 ng/uL.

Primary T Cell In Vitro Cytotoxicity Assays

Killing of MSLN(+)A*02(−)RFP(+) tumor or MSLN(+)A*02(+)GFP(+) normal target cells by primary T cells transduced with Gen2 M5 CAR, MSLN CAR3 or CAR3 Tmod single vector constructs was assessed as previously described[9]. Briefly, 2,000 target cells were plated in 25 uL complete LymphoOne media (containing 1% HIA human AB serum) per well in a black, clear-bottom 384-well plate and allowed to adhere overnight at 37° C. with 5% $CO_2$. For mixed culture assays, target cells were pre-mixed at the desired ratios prior to seeding. ~16-18 h after target cell plating, T cells were counted, spun down at 300×g for 10 min and resuspended at 2,000 CAR(+) or Tmod(+) T cells in 25 uL complete LymphoOne media (in the absence of additional cytokines) for an effective effector:target (E:T)=1:1 (or more or less concentrated depending on the desired E:T) and gently plated on top of the target cells. For experiments including sMSLN, T cells were resuspended in LymphoOne media containing 1000 ng/mL (2×) soluble, monomeric MSLN (Acro Biosystems) for a final concentration of 500 ng/mL upon plating with target cells. Each sample was tested in triplicate wells. Within 30 min of co-culture, the plate was imaged for GFP(+) or RFP(+) target cell expression using an Incucyte imager and serial images were obtained every 2-4 h thereafter for up to 48 h. Quantification of target cell area (i.e., GFP(+) or RFP(+) total area per image) was done using Incucyte imaging software. Plating variability was accounted for by normalizing to area at time=0 per well. Killing was then quantified as the difference in area between CAR or Tmod T cell wells to corresponding untransduced T cell wells, normalized to the untrasduced T cell well (% Killing=$(A_{untransduced} - A_{CAR\ or\ Tmod})/A_{untransduced}$).

For HLA-A*11 blocker evaluation in primary T cells, cytotoxicity assays were performed as described above, using HeLa target cells that express native levels of MSLN and transgenic HLA-A*11 antigen.

To further assess cytokine secretion and relative T cell activation post-48 h co-culture, the T cell containing media in each well was mixed and transferred to a v-bottom plate and spun down at 400×g for 5 min. Supernatants were collected and frozen until further analysis for secreted IFN-γ using a BD Human IFN-γ flex kit as per manufacturer's instructions. Remaining T cells were then stained for human CD3, washed, and characterized for forward and side scatter by flow cytometry [35].

Repeat Antigen-Challenge Assay (RACA) and Reversibility Assays

The RACA and reversibility assays were performed as previously described (Wang et al., in press [18]) with some modifications. Briefly, CAR or Tmod transduced primary T cells were co-cultured with MSLN(+)A*02(−) RFP(+) tumor or MSLN(+)A*02(+) GFP(+) normal target cells similarly as described above with effective E:T=1.2:1. Round 1 images were taken over the course of 48 h in a 384-well plate format. Parallel 6-well plates with 250,000 target cells and 300,000 CAR3(+) or CAR3 Tmod(+) T cells were also set up to allow for bulk T cell isolation and transfer between rounds. After 48 h, T cell containing media was gently mixed and transferred to conical tubes. Remaining T cells engaged with live target cells were further dissociated by a single 1-min rinse with 10 mM EDTA+0.5% BSA in PBS and combined with the bulk T cell fraction. These cells (along with target cell debris and lifted target cells) were then spun down, washed, and stained with a cocktail of anti-MSLN, anti-EGFR, and anti-N-cadherin PE-conjugated antibodies to stain undesirable target cells. These target cells were then conjugated to anti-PE MACS beads followed by depletion through LS columns, resulting in clean T cell fractions. T cells were then counted and re-seeded for round 2 (similarly to round 1) onto fresh tumor or normal target cells. Imaging and quantification then proceeded exactly as was done in round 1.

MSLN Knockout Cell Line Generation

To develop MSLN(−) cell line controls for endogenous MSLN(+) cell lines, a CRISPR strategy to target full-length MSLN was utilized. Two Alt-R CRISPR-Cas9 sgRNAs targeting different exons of mesothelin were obtained from Integrated DNA Technologies (IDT), with sgRNA_1 targeting exon 2, and sgRNA_2 targeting exon 16. The sgRNAs were rehydrated in nuclease-free water and combined with Alt-R® S.p. HiFi Cas9 Nuclease V3 (IDT) to yield a 9:1 sgRNA:Cas9 mole ratio. Both RNP solutions were incubated at room temperature for 10-20 min separately to allow each of the guides to complex with Cas9 independently. The RNP complexes of both guides were subsequently combined, added to the desired cells as per the manufacturer's instructions, and electroporated. After CRISPR, cells were scaled up and sorted on the MSLN(−) population (R&D, anti-MSLN pAb or clone #618923). Bulk-sorted MSLN(−) cells were then screened against MSLN binders in Jurkat cell-based assays.

Selectivity Screening Using Jurkat Cells

To explore off-target reactivity of MSLN CAR3 Tmod cells, Jurkat cell activation was tested against a diverse panel of target cell lines chosen to encompass the large majority of adult gene expression similarly as described elsewhere (Wang et al., in preparation). Positive controls were used to confirm that effector cells could be activated by MSLN(+) cell lines, and negative controls to set a baseline for response (see FIGS. 26B and 28A for cell line characterization). Briefly, Jurkat-NFAT-Luciferase cells were transiently transfected to express either CARs or CAR3 Tmod exactly as described above. In parallel, endogenous MSLN(+) target cells, along with their respective MSLN(−) control target cells generated using CRISPR as described above, were plated at 1e4 target cells in 15 uL complete RPMI (containing 10% FBS and 1% P/S) per well in a 384-well plate format. Approximately 18 h post-transfection, 1e4 Jurkat cells were co-cultured with each target cell and activity compared to Gen2 M5 CAR was assessed via luminescence after 6 h. Luciferase activity was measured using ONE-Step Luciferase Assay System (BPS Bioscience).

Mouse Xenograft Study

Blinded in vivo experiments were conducted by Explora BioLabs under Institutional Animal Care and Use Committee (IACUC)-approved protocols. 5-6 week old female NOD.Cg-Prkdcscid Il2rgtm1Wj1 Tg(HLA-A/H2-D/B2M)1Dvs/SzJ (NSG-HLA-A2/HHD) mice were purchased from The Jackson Labs. Animals were acclimated to the housing environment prior to the initiation of the study. Animals (10/cohort) were implanted subcutaneously with 5e6 MS751 firefly luciferase(+) HLA-A KO tumor or *Renilla* luciferase(+) A*02 transgenic normal cells mixed 1:1 with Matrigel in 100 uL on their right and left flanks, respectively, in half of the mice in each cohort, and vice versa in the other half to control for flank growth variation. When tumors reached an average of 100-150 mm³ each (V=L×W×W/2), animals were randomized into 5 groups (n=10) and 2e7 T cells, or saline control, were administered via the tail vein. Prior to injection, T cells were ~60% CAR(+) or Tmod(+). Post T cell injection, graft measurements by calipers were performed 3× times per week and BLI 1× time per week for the duration of the study. At each BLI session, RediJect Coelenterazine h substrate (PerkinElmer) was first injected to visualize *Renilla* luciferase(+) normal cells, followed by injection of XenoLight D-Luciferin Potassium Salt (PerkinElmer) 6 h later to visualize firefly luciferase(+) tumor cells on the reverse flank.

CRISPR Knockout of B2M in Primary T Cells

Frozen PBMCs were thawed and activated as described above. Transductions were performed 24 h post-activation using lentivirus (Alstem) at MOI 10. 24 h post-transduction, primary T cells were transfected with CRISPR-Cas9:sgRNA complexes. Briefly, cells were collected and washed with PBS before resuspending in supplemented P3 nucleofection buffer (Lonza). 20 pmol of Cas9 (Synthego) was combined with 130 pmol B2M-targeting sgRNA (Synthego) and incubated in P3 nucleofection buffer before addition to cells. 20 uL of the cell and ribonucleoprotein (RNP) mixture was transferred to a 16-well Nucleocuvette Strip and electroporated with the 4D nucleofector using the stimulated T cell program (EO-115). The cells were recovered in 100 uL of prewarmed media, X-VIVO 15 (Lonza) supplemented with 5% HIA human AB serum and 300 IU/mL IL-2. PBMCs were cultured and expanded in LymphoONE Tcell Expansion Medium (Takara Bio) supplemented with 1% HIA human AB serum and 300 IU/mL IL-2 for 6 days. Post expansion, positively transduced primary T cells were enriched using anti-PE microbeads (Miltenyi) according to manufacturer's instructions against Protein L-biotin: streptavidin-PE using LS column. Cytotoxicity of B2M KO primary T cells was then assessed exactly as described above.

Statistical Analysis

Statistical analyses were performed using GraphPad Prism software. All Jurkat cell-based in vitro studies (including mRNA titration experiments) are shown as mean±standard deviation (SD) of technical replicates, while primary T cell-based in vitro studies are shown as mean±SD of technical triplicates. Where applicable, technical replicates are shown as individual data points, with bars denoting means. All data is representative of a minimum of n=2 experimental repeats, unless otherwise noted. Data for in vivo studies are shown as mean±standard error of the mean (SEM). For mRNA titration studies, curves were fit using a four-parameter non-linear regression analysis. $EC_{50}$ and $IC_{50}$ values were calculated directly from the curves. Direct comparisons were analyzed using unpaired, parametric t tests, unless otherwise noted.

REFERENCES

1. Chang, K., Pai, L. H., Batra, J. K., Pastan, I. & Willingham, M. C. Characterization of the antigen (CAK1) recognized by monoclonal antibody K1 present on ovarian cancers and normal mesothelium. Cancer Res 52, 181-186 (1992).
2. Hassan, R. et al. Mesothelin Immunotherapy for Cancer: Ready for Prime Time? J Clin Oncol 34, 4171-4179, doi:10.1200/JCO.2016.68.3672 (2016).
3. Bera, T. K. & Pastan, I. Mesothelin is not required for normal mouse development or reproduction. Mol Cell Biol 20, 2902-2906, doi:10.1128/MCB.20.8.2902-2906.2000 (2000).
4. O'Hara, M. H., Stashwick, C., Plesa, G. & Tanyi, J. L. Overcoming barriers of car T-cell therapy in patients with mesothelin-expressing cancers. Immunotherapy 9, 767-780, doi:10.2217/imt-2017-0026 (2017).
5. Chowdhury, P. S., Viner, J. L., Beers, R. & Pastan, I. Isolation of a high-affinity stable single-chain Fv specific for mesothelin from DNA-immunized mice by phage display and construction of a recombinant immunotoxin with anti-tumor activity. Proc Natl Acad Sci USA 95, 669-674, doi:10.1073/pnas.95.2.669 (1998).
6. Hassan, R. et al. Phase I study of SS1P, a recombinant anti-mesothelin immunotoxin given as a bolus I.V. infusion to patients with mesothelin-expressing mesothelioma, ovarian, and pancreatic cancers. Clin Cancer Res 13, 5144-5149, doi:10.1158/1078-0432.CCR-07-0869 (2007).
7. Golfier, S. et al. Anetumab ravtansine: a novel mesothelin-targeting antibody-drug conjugate cures tumors with heterogeneous target expression favored by bystander effect. Mol Cancer Ther 13, 1537-1548, doi:10.1158/1535-7163.MCT-13-0926 (2014).
8. Luke, J. J. et al. Phase I study of ABBV-428, a mesothelin-CD40 bispecific, in patients with advanced solid tumors. J Immunother Cancer 9, doi:10.1136/jitc-2020-002015 (2021).
9. Beatty, G. L. et al. Activity of Mesothelin-Specific Chimeric Antigen Receptor T Cells Against Pancreatic Carcinoma Metastases in a Phase 1 Trial. Gastroenterology 155, 29-32, doi:10.1053/j.gastro.2018.03.029 (2018).
10. Ding, J. et al. Abstract 2307: Preclinical evaluation of TC-210, a mesothelin-specific T cell receptor (TCR) fusion construct (TRuC™) T cells for the treatment of solid tumors. Cancer Research 79, 2307-2307, doi: 10.1158/1538-7445. Am2019-2307 (2019).
11. Adusumilli, P. S. et al. Regional delivery of mesothelin-targeted CAR T cells for pleural cancers: Safety and preliminary efficacy in combination with anti-PD-1 agent. Journal of Clinical Oncology 37, 2511-2511, doi:10.1200/JCO.2019.37.15_suppl.2511 (2019).
12. Feng, Y. et al. A novel human monoclonal antibody that binds with high affinity to mesothelin-expressing cells and kills them by antibody-dependent cell-mediated cytotoxicity. Mol Cancer Ther 8, 1113-1118, doi:10.1158/1535-7163.MCT-08-0945 (2009).
13. Klampatsa, A., Dimou, V. & Albelda, S. M. Mesothelin-targeted CAR-T cell therapy for solid tumors. Expert Opin Biol Ther 21, 473-486, doi:10.1080/14712598.2021.1843628 (2021).
14. Tanyi, J. L. et al. Possible Compartmental Cytokine Release Syndrome in a Patient With Recurrent Ovarian Cancer After Treatment With Mesothelin-targeted CAR-T Cells. J Immunother 40, 104-107, doi:10.1097/CJI.0000000000000160 (2017).
15. James, S. E. et al. Mathematical modeling of chimeric TCR triggering predicts the magnitude of target lysis and its impairment by TCR downmodulation. J Immunol 184, 4284-4294, doi:10.4049/jimmunol.0903701 (2010).
16. Xu, H. et al. Structure-function relationships of chimeric antigen receptors in acute T cell responses to antigen. Mol Immunol 126, 56-64, doi:10.1016/j.molimm.2020.07.020 (2020).
17. Smith, K. B. & Ellis, S. A. Standardisation of a procedure for quantifying surface antigens by indirect immunofluorescence. J Immunol Methods 228, 29-36, doi:10.1016/s0022-1759(99)00087-3 (1999).
18. Hamburger, A. E. et al. Engineered T cells directed at tumors with defined allelic loss. Mol Immunol 128, 298-310, doi:10.1016/j.molimm.2020.09.012 (2020).
19. Hassan, R. et al. Phase 1 study of the antimesothelin immunotoxin SS1P in combination with pemetrexed and cisplatin for front-line therapy of pleural mesothelioma and correlation of tumor response with serum mesothelin, megakaryocyte potentiating factor, and cancer antigen 125. Cancer 120, 3311-3319, doi:10.1002/cncr.28875 (2014).
20. Gragert, L., Madbouly, A., Freeman, J. & Maiers, M. Six-locus high resolution HLA haplotype frequencies derived from mixed-resolution DNA typing for the entire US donor registry. Hum Immunol 74, 1313-1320, doi: 10.1016/j.humimm.2013.06.025 (2013).
21. Fedorov, V. D., Themeli, M. & Sadelain, M. PD-1- and CTLA-4-based inhibitory chimeric antigen receptors divert off-target immunotherapy responses. Sci Transl Med 5, 215ra172, doi:10.1126/scitranslmed.3006597 (2013).
22. Hwang, M. S. et al. Targeting loss of heterozygosity for cancer-specific immunotherapy. Proc Natl Acad Sci USA 118, doi:10.1073/pnas.2022410118 (2021).
23. Roex, G. et al. Chimeric Antigen Receptor-T-Cell Therapy for B-Cell Hematological Malignancies: An Update of the Pivotal Clinical Trial Data. Pharmaceutics 12, doi:10.3390/pharmaceutics12020194 (2020).
24. Mastrogiovanni, M., Juzans, M., Alcover, A. & Di Bartolo, V. Coordinating Cytoskeleton and Molecular Traffic in T Cell Migration, Activation, and Effector Functions. Front Cell Dev Biol 8, 591348, doi:10.3389/fcell.2020.591348 (2020).

25 Lopez, S. et al. Interplay between whole-genome doubling and the accumulation of deleterious alterations in cancer evolution. Nat Genet 52, 283-293, doi:10.1038/s41588-020-0584-7 (2020).
26 Foo, J. & Michor, F. Evolution of acquired resistance to anti-cancer therapy. J Theor Biol 355, 10-20, doi:10.1016/j.jtbi.2014.02.025 (2014).
27 Beaubier, N. et al. Clinical validation of the tempus xT next-generation targeted oncology sequencing assay. Oncotarget 10, 2384-2396, doi:10.18632/oncotarget.26797 (2019).
28 Consortium, I. T. P.-C. A. o. W. G. Pan-cancer analysis of whole genomes. Nature 578, 82-93, doi:10.1038/s41586-020-1969-6 (2020).
29 Ford, L., Wolford, J. E., Brown, S. M. & Randall, L. M. A profile on the FoundationFocus CDxBRCA tests. Expert Rev Mol Diagn 20, 285-292, doi:10.1080/14737159.2020.1701438 (2020).
30 Beroukhim, R. et al. The landscape of somatic copy-number alteration across human cancers. Nature 463, 899-905, doi:10.1038/nature08822 (2010).
31 Gold, P. & Freedman, S. O. Specific carcinoembryonic antigens of the human digestive system. J Exp Med 122, 467-481, doi:10.1084/jem.122.3.467 (1965).
32 Parham, P. & Bodmer, W. F. Monoclonal antibody to a human histocompatibility alloantigen, HLA-A2. Nature 276, 397-399, doi:10.1038/276397a0 (1978).
33. Tanyi, J. L. et al. Possible Compartmental Cytokine Release Syndrome in a Patient With Recurrent Ovarian Cancer After Treatment With Mesothelin-targeted CAR-T Cells. *J Immunother* 40, 104-107 (2017).
34. Montesion, M. et al. Somatic HLA Class I Loss Is a Widespread Mechanism of Immune Evasion Which Refines the Use of Tumor Mutational Burden as a Biomarker of Checkpoint Inhibitor Response. *Cancer Discov* 11, 282-292 (2021).
35. Bohmer et al., Forward light scatter is a simple measure of T-cell activation and proliferation but is not universally suited for doublet discrimination. Cytometry 79A(8):646-652 (2011).
36. Berger et al. Monoclonal antibody to HLA-A3. Hybridoma 1(2):87-90 (1982).
37. Brodsky et al., Monoclonal antibodies for analysis of the HLA system. Immunol Rev. 47:3-61 (1979).

SEQUENCE LISTING (1255 sequences)

SEQ ID NO: 1 - protein, 622 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 2 - protein, 630 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQAPRRPLPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 3 - protein, 237 aa, Artificial Sequence
  MSLN scFv domain
QVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSGGDIVMTQSSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIK

SEQ ID NO: 4 - protein, 246 aa, Artificial Sequence
  MSLN scFv domain
QVQLVQSGAEVRAPGASVKISCKASGFTFRGYYIHWVRQAPGQGLEWMGIINPSGGSRAYAQKFQGRVTMTRDTSTSTVYMELSSLRSDDTAMYYCARTASCGGDCYYLDYWGQGTLVTVSSGGGGSGGGGSGGGGSGGDIQMTQSPPTLSASVGDRVTITCRASENVNIWLAWYQQKPGKAPKLLIYKSSSLASGVPSRFSGSGSGAEFTLTISSLQPDDFATYYCQQYQSYPLTFGGGTKVEIK

SEQ ID NO: 5 - protein, 242 aa, Artificial Sequence
  MSLN scFv domain
QVQLVQSGAEVKKPGASVKVSCKASGYSFTGYTMNWVRQAPGQRLEWMGLITPYNGASSYNQKFRGRVTITRDTSASTAYMELSSLRSEDTAVYYCARGGYDGRGFDYWGQGTTVTVSSGGGGSGGGGSGGGGSGGDIQMTQSPSSLSASVGDRVTITCSASSSVSYMHWYQQKPGKAPKRLIYDTSKLASGVPSRFSGSGSGTEFTLTISSLQPEDFATYYCQQWSGYPLTFGQGTKLEIK

SEQ ID NO: 6 - protein, 242 aa, Artificial Sequence
  MSLN scFv domain
QVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSGGDIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEIK

SEQ ID NO: 7 - protein, 45 aa, Unknown
  CD8alpha hinge
TTTPAPRPPTPAPTIASQPLSLRPEACRPAAGGAVHTRGLDFACD

SEQ ID NO: 8 - DNA, 135 bp, Unknown
  encodes CD8alpha hinge
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgat

SEQ ID NO: 9 - protein, 41 aa, Unknown
  CD28 hinge
CTIEVMYPPPYLDNEKSNGTIIHVKGKHLCPSPLFPGPSKP

SEQ ID NO: 10 - DNA, 123 bp, Unknown
  encodes CD28 hinge
tgtaccattgaagttatgtatcctcctccttacctagacaatgagaagagcaatggaaccattatccatgtgaaagggaaacacctttgtccaagtcccctatttcccggaccttctaagccc

SEQ ID NO: 11 - protein, 27 aa, Unknown
  CD28 transmembrane domain
FWVLVVVGGVLACYSLLVTVAFIIFWV

SEQ ID NO: 12 - DNA, 81 bp, Unknown
  encodes CD28 transmembrane domain
ttctgggtgctggtcgttgtgggcggcgtgctggcctgctacagcctgctggtgacagtggccttcatcatcttttgggtg

SEQ ID NO: 13 - protein, 25 aa, Unknown
  IL-2Rbeta transmembrane domain
IPWLGHLLVGLSGAFGFIILVYLLI

SEQ ID NO: 14 - DNA, 75 bp, Unknown
  encodes IL-2Rbeta transmembrane domain
attccgtggctcggccacctcctcgtgggcctcagcggggcttttggcttcatcatcttagtgtacttgctgatc

SEQ ID NO: 15 - protein, 112 aa, Unknown
  CD3zeta activation domain
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 16 - DNA, 336 bp, Unknown
  encodes CD3zeta activation domain
agagtgaagttcagcaggagcgcagacgcccccgcgtacaagcagggccagaaccagctctataacgagctcaatctaggacgaagagaggagtacgatgttttggacaagcgtagaggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggactcagtacagccaccaaggacacctacgacgcccttcacatgcaggccctgccccctcgc

SEQ ID NO: 17 - protein, 43 aa, Unknown
  CD3zeta activation domain
RVKFSRSADAPAYQQGQNQLYNELNLGRREEYDVLHMQALPPR

SEQ ID NO: 18 - DNA, 129 bp, Unknown
  encodes CD3zeta activation domain
agagtgaagttcagcaggagcgcagacgcccccgcgtaccagcagggccagaaccagctctataacgagctcaatctaggacgaagagaggagtacgatgttttgcacatgcaggccctgccccctcgc

SEQ ID NO: 19 - protein, 41 aa, Unknown
  CD28 co-stimulatory domain
RSKRSRLLHSDYMNMTPRRPGPTRKHYQPYAPPRDFAAYRS

SEQ ID NO: 20 - DNA, 123 bp, Unknown
  encodes CD28 co-stimulatory domain
aggagcaagcggagcagactgctgcacagcgactacatgaacatgaccccccggaggcctggccccacccggaagcactaccagccctacgcccctcccagggatttcgccgcctaccggagc

SEQ ID NO: 21 - protein, 23 aa, Unknown
  TCR alpha transmembrane domain
VIGFRILLLKVAGFNLLMTLRLW

SEQ ID NO: 22 - DNA, 69 bp, Unknown
  encodes TCR alpha transmembrane domain
gtgattgggttccgaatcctcctcctgaaagtggccgggtttaatctgctcatgacgctgcggctgtgg

SEQ ID NO: 23 - protein, 23 aa, Unknown
  TCR beta transmembrane domain
TILYEILLGKATLYAVLVSALVL

SEQ ID NO: 24 - DNA, 69 bp, Unknown
  encodes TCR beta transmembrane domain
accatcctctatgagatcttgctagggaaggccaccttgtatgccgtgctggtcagtgccctcgtgctg

SEQ ID NO: 25 - protein, 10 aa, Unknown
  TCR beta intracellular domain
MAMVKRKDSR

SEQ ID NO: 26 - DNA, 30 bp, Unknown
  encodes TCR beta intracellular domain
atggccatggtcaagagaaaggattccaga

SEQ ID NO: 27 - protein, 532 aa, Homo sapiens
MAPSSPRPALPALLVLLGALFPGPGNAQTSVSPSKVILPRGGSVLVTCSTSCDQPKLLGIETPLPKKELLLPGNNRKVYELSNVQEDSQPMCYSNCPDGQSTAKTFLTVYWTPERVELAPLPSWQPVGKNLTLRCQVEGGAPRANLTVVLLRGEKELKREPAVGEPAEVTTTVLVRRDHHGANFSCRTELDLRPQGLELFENTSAPYQLQTFVLPATPPQLVSPRVLEVDTQGTVVCSLDGLFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTRKVTVNVLSPRYEIVIITVVAAAVIMGTAGLSTYLYNRQRKIKKYRLQQAQKGTPMKPNTQATPP

SEQ ID NO: 28 - protein, 271 aa, Homo sapiens
MPEAPPLLLAAVLLGLVLLVVLLLLLRHWGWGLCLIGWNEFILQPIHNLLMGDTKEQRILNHVLQHAEPGNAQSVLEAIDTYCEQKEWAMNVGDKKGKIVDAVIQEHQPSVLLELGAYCGYSAVRMARLLSPGARLITIEINPDCAAITQRMVDFAGVKDKVTLVVGASQDIIPQLKKKYDVDTLDMVFLDHWKDRYLPDTLLLEECGLLRKGTVLLADNVICPGAPDFLAHVRGSSCFECTHYQSFLEYREVVDGLEKAIYKGPGSEAGP

SEQ ID NO: 29 - protein, 273 aa, Homo sapiens
MSGSQSEVAPSPQSPRSPEMGRDLRPGSRVLLLLLLLLLVYLTQPGNGNEGSVTGSCYCGKRISSDSPPSVQFMNRLRKHLRAYHRCLYYTRFQLLSWSVCGGNKDPWVQELMSCLDLKECGHAYSGIVAHQKHLLPTSPPISQASEGASSDIHTPAQMLLSTLQSTQRPTLPVGSLSSDKELTRPNETTIHTAGHSLAAGPEAGENQKQPEKNAGPTARTSATVPVLCLLAIIFILTAALSYVLCKRRRGQSPQSSPDLPVHYIPVAPDSNT

SEQ ID NO: 30 - protein, 247 aa, Artificial Sequence
  HLA scFv binding domain
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPRTSGGGTKLEIKGGGGSGGGGSGGGGSGGQVQLQQSGPELVKPGASVRISCKASGYTFTSYHIHWVKQRPGQGLEWIGWIYPGNVNTEYNEKFKGKATLTADKSSSTAYMHLSSLTSEDSAVYFCAREEITYAMDYWGQGTSVTVSS

SEQ ID NO: 31 - protein, 247 aa, Artificial Sequence
  HLA scFv binding domain
QVQLVQSGAEVKKPGSSVKVSCKASGYTFTSYHIHWVRQAPGQGLEWMGWIYPGNVNTEYNEKFKGKATITADKSTSTAYMELSSLRSEDTAVYYCAREEITYAMDYWGQGTTVTVSSGGGGSGGGGSGGGGSGGEIVLTQSPGTLSLSPGERATLSCRSSQSIVHSNGNTYLEWYQQKPGQAPRLLIYKVSNRFSGIPDRFSGSGSGTDFTLTISRLEPEDFAVYYCFQGSHVPRTFGGGTKVEIK

SEQ ID NO: 32 - protein, 247 aa, Artificial Sequence
  HLA scFv binding domain
QVQLVQSGAEVKKPGSSVKVSCKASGYTFTSYHIHWVRQAPGQGLEWMGWIYPGNVNTEYNEKFKGKATITADKSTSTAYMELSSLRSEDTAVYYCAREEITYAMDYWGQGTTVTVSSGGGGSGGGGSGGGGSGGDIVMTQTPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPRTFGGGTKVEIK

SEQ ID NO: 33 - protein, 247 aa, Artificial Sequence
  HLA scFv binding domain
EVQLVESGGGLVKPGGSLRLSCAASGYTFTSYHIHWVRQAPGKGLEWVGWIYPGNVNTEYNEKFKGRFTISRDDSKNTLYLQMNSLKTEDTAVYYCAREEITYAMDYWGQGTTVTVSSGGGGSGGGGSGGGGSGGDIQMTQSPSSLSASVGDRVTITCRSSQSIVHSNGNTYLEWYQQKPGKAPKLLIYKVSNRFSGVPSRFSGSGSGTDFTLTISSLQPEDFATYYCFQGSHVPRTFGGGTKVEIK

SEQ ID NO: 34 - protein, 247 aa, Artificial Sequence
  HLA scFv binding domain
QVQLVQSGAEVKKPGSSVKVSCKASGYTFTSYHIHWVRQAPGQGLEWIGWIYPGNVNTEYNEKFKGKATITADESTNTAYMELSSLRSEDTAVYYCAREEITYAMDYWGQGTLVTVSSGGGGSGGGGSGGGGSGGDIQMTQSPSTLSASVGDRVTITCRSSQSIVHSNGNTYLEWYQQKPGKAPKLLIYKVSNRFSGVPARFSGSGSGTEFTLTISSLQPDDFATYYCFQGSHVPRTFGQGTKVEVK

SEQ ID NO: 35 - protein, 247 aa, Artificial Sequence
  HLA scFv binding domain
QVQLVQSGAEVKKPGSSVKVSCKASGYTFTSYHMHWVRQAPGQGLEWIGYIYPGNVNTEYNEKFKGKATLTADKSTNTAYMELSSLRSEDTAVYFCAREEITYAMDYWGQGTLVTVSSGGGGSGGGGSGGGGSGGDVQMTQSPSTLSASVGDRVTITCSSSQSIVHSNGNTYMEWYQQKPGKAPKLLIYKVSNRFSGVPDRFSGSGSGTEFTLTISSLQPDDFATYYCHQGSHVPRTFGQGTKVEVK

SEQ ID NO: 36 - protein, 247 aa, Artificial Sequence
  HLA scFv binding domain
QVQLQQSGPELVKPGASVKMSCKASGYTFTSYHIQWVKQRPGQGLEWIGWIYPGDGSTQYNEKFKGKTTLTADKSSSTAYMLLSSLTSEDSAIYFCAREGTYYAMDYWGQGTSVTVSSGGGGSGGGGSGGGGSGGDVLMTQTPLSLPVSLGDQVSISCRSSQSIVHSNGNTYLEWYLQKPGQSPKLLIYKVSNRFSGVPDRFSGSGSGTDFTLKISRVEAEDLGVYYCFQGSHVPRTFGGGTKLEIK

SEQ ID NO: 37 - protein, 247 aa, Artificial Sequence
  HLA scFv binding domain
QLQLQESGPGLVKPSETLSLTCTVSGYTFTSYHIQWIRQPPGKGLEWIGWIYPGDGSTQYNEKFKGRATISVDTSKNQFSLNLDSVSAADTAIYYCAREGTYYAMDYWGKGSTVTVSSGGGGSGGGGSGGGGSGGDIQMTQSPSSLSASVGDRVTITCRSSQSIVHSNGNTYLEWYQQKPGKAPKLLIYKVSNRFSGVPSRFSGSGSGTDFTFTISSLQPEDIATYYCFQGSHVPRTFGPGTKVDIK

SEQ ID NO: 38 - protein, 247 aa, Artificial Sequence
  HLA scFv binding domain
EVQLVQSGAELKKPGSSVKVSCKASGYTFTSYHIQWVKQAPGQGLEWIGWIYPGDGSTQYNEKFKGKATLTVDKSTNTAYMELSSLRSEDTAVYYCAREGTYYAMDYWGQGTLVTVSSGGGGSGGGGSGGGGSGGDIQMTQSPSTLSASVGDRVTITCRSSQSIVHSNGNTYLEWYQQKPGKAPKLLIYKVSNRFSGVPSRFSGSGSGTDFTLTISSLQPDDFATYYCFQGSHVPRTFGQGTKVEVK

SEQ ID NO: 39 - protein, 247 aa, Artificial Sequence
  HLA scFv binding domain
QVQLVQSGAEVKKPGSSVKVSCKASGYTFTSYHIQWVRQAPGQGLEWMGWIYPGDGSTQYNEKFKGRVTITADKSTSTAYMELSSLRSEDTAVYYCAREGTYYAMDYWGQGTTVTVSSGGGGSGGGGSGGGGSGGEIVLTQSPGTLSLSPGERATLSCRSSQSIVHSNGNTYLEWYQQKPGQAPRLLIYKVSNRFSGIPDRFSGSGSGTDFTLTISRLEPEDFAVYYCFQGSHVPRTFGGGTKVEIK

SEQ ID NO: 40 - protein, 247 aa, Artificial Sequence
  HLA scFv binding domain
QVTLKQSGAEVKKPGSSVKVSCTASGYTFTSYHVSWVRQAPGQGLEWLGRIYPGDGSTQYNEKFKGKVTITADKSMDTSFMELTSLTSEDTAVYYCAREGTYYAMDLWGQGTLVTVSSGGGGSGGGGSGGGGSGGEIVLTQSPGTLSLSPGERATLSCRSSQSIVHSNGNTYLAWYQQKPGQAPRLLISKVSNRFSGVPDRFSGSGSGTDFTLTISRLEPEDFAVYYCQQGSHVPRTFGGGTKVEIK

SEQ ID NO: 41 - protein, 247 aa, Artificial Sequence
  HLA scFv binding domain
QVQLVQSGAEVKKPGASVKVSCKASGYTFTSYHMHWVRQAPGQRLEWMGWIYPGDGSTQYNEKFKGKVTITRDTSASTAYMELSSLRSEDTAVYYCAREGTYYAMDYWGQGTLVTVSSGGGGSGGGGSGGGGSGGDIVMTQTPLSLPVTPGEPASISCRSSQSIVHSNGNTYLDWYLQKPGQSPQLLIYKVSNRFSGVPDRFSGSGSGTDFTLKISRVEAEDVGVYYCMQGSHVPRTFGGGTKVEIK

SEQ ID NO: 42 - protein, 16 aa, Artificial Sequence
  HLA antigen binding domain CDR-L1
RSSQSIVHSNGNTYLE

SEQ ID NO: 43 - protein, 12 aa, Artificial Sequence
  HLA antigen binding domain CDR-L2
KVSNRFSGVPDR

SEQ ID NO: 44 - protein, 9 aa, Artificial Sequence
  HLA antigen binding domain CDR-L3
FQGSHVPRT

SEQ ID NO: 45 - protein, 12 aa, Artificial Sequence
  HLA antigen binding domain CDR-H1
ASGYTFTSYHIH

SEQ ID NO: 46 - protein, 18 aa, Artificial Sequence
  HLA antigen binding domain CDR-H2
WIYPGNVNTEYNEKFKGK

SEQ ID NO: 47 - protein, 9 aa, Artificial Sequence
  HLA antigen binding domain CDR-H3
EEITYAMDY

SEQ ID NO: 48 - protein, 16 aa, Artificial Sequence
  HLA antigen binding domain CDR-L1
RSSQSIVHSNGNTYLD

SEQ ID NO: 49 - protein, 12 aa, Artificial Sequence
  HLA antigen binding domain CDR-L2
KVSNRFSGVPDR

SEQ ID NO: 50 - protein, 9 aa, Artificial Sequence
  HLA antigen binding domain CDR-L3
MQGSHVPRT

SEQ ID NO: 51 - protein, 11 aa, Artificial Sequence
  HLA antigen binding domain CDR-H1
SGYTFTSYHMH

SEQ ID NO: 52 - protein, 17 aa, Artificial Sequence
  HLA antigen binding domain CDR-H2
WIYPGDGSTQYNEKFKG

SEQ ID NO: 53 - protein, 9 aa, Artificial Sequence
  HLA antigen binding domain CDR-H3
EGTYYAMDY

SEQ ID NO: 54 - protein, 670 aa, Unknown
  LILRB1
MTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIHPSQEGPSPAVPSIYATLAIH

SEQ ID NO: 55 - DNA, 3229 bp, Unknown
  LILRB1
aaatgagttttaaaaaggcttgtccaggaagcacatatgggagctggtcactctgcattttgggccctcctggaggtgtttagaccttccgagagagaaactgagacacatgagagggaagaaatgactcagtggtgagaccctgtggagtcccacccacaaccagcacactgtgacccactgcacaaacctctagcccacagctcacttcctcctttaagaagagaagagaaaagaggagaggagaggaggaacagaaaagaaaagaaaagaaaaagtgggaaacaaataatctaagaatgaggagaaagcaagaagagtgacccccttgtgggcactccattggttttatggcgcctctactttctggagtttgtgtaaaacaaaaatattatggtctttgtgcacatttacatcaagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggcccccggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcaccctggattacacggatcccacaggagcttgtgaagaagggccagttccccatcccatccatcacctgggaacacacagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcattctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaattaaaaaaaaaaaaaaaaaagaaagaaaaaaaaaaaaaaaaaa

SEQ ID NO: 56 - protein, 6 aa, Unknown
  immunoreceptor tyrosine-based inhibitory motif
NLYAAV

SEQ ID NO: 57 - protein, 6 aa, Unknown
  immunoreceptor tyrosine-based inhibitory motif
VTYAEV

SEQ ID NO: 58 - protein, 6 aa, Unknown
  immunoreceptor tyrosine-based inhibitory motif
VTYAQL

SEQ ID NO: 59 - protein, 6 aa, Unknown
  immunoreceptor tyrosine-based inhibitory motif
SIYATL

SEQ ID NO: 60 - protein, 35 aa, Unknown
  ITIM1-2
NLYAAVKHTQPEDGVEMDTRSPHDEDPQAVTYAEV

SEQ ID NO: 61 - protein, 58 aa, Unknown
  ITIM2-3
VTYAEVKHSRPRREMASPPSPLSGEFLDTKDRQAEEDRQMDTEAAASEAPQDVTYAQL

SEQ ID NO: 62 - protein, 36 aa, Unknown
  ITIM3-4
VTYAQLHSLTLRREATEPPPSQEGPSPAVPSIYATL

SEQ ID NO: 63 - protein, 87 aa, Unknown
  ITIM1-3
NLYAAVKHTQPEDGVEMDTRSPHDEDPQAVTYAEVKHSRPRREMASPPSPLSGEFLDTKDRQAEEDRQMDTEAAASEAPQDVTYAQL

SEQ ID NO: 64 - protein, 88 aa, Unknown
  ITIM2-4
VTYAEVKHSRPRREMASPPSPLSGEFLDTKDRQAEEDRQMDTEAAASEAPQDVTYAQLHSLTLRREATEPPPSQEGPSPAVPSIYATL

SEQ ID NO: 65 - protein, 117 aa, Unknown
  ITIM1-4
NLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATL

SEQ ID NO: 66 - protein, 20 aa, Unknown
  D3D4 domain
YGSQSSKPYLLTHPSDPLEL

SEQ ID NO: 67 - protein, 43 aa, Unknown
  Short hinge
VVSGPSGGPSSPTTGPTSTSGPEDQPLTPTGSDPQSGLGRHLG

SEQ ID NO: 68 - protein, 86 aa, Unknown
  Hinge-transmembrane
YGSQSSKPYLLTHPSDPLELVVSGPSGGPSSPTTGPTSTSGPEDQPLTPTGSDPQSGLGRHLGVVIGILVAVILLLLLLLLLFLIL

SEQ ID NO: 69 - protein, 190 aa, Unknown
  Transmembrane-intracellular domain.
VVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 70 - protein, 167 aa, Unknown
  LILRB1 intracellular domain
RHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 71 - protein, 253 aa, Unknown
  LILRB1 hinge-transmembrane-intracellular domain
YGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 72 - protein, 233 aa, Unknown
  LILRB1  hinge-transmembrane-intracellular domain
VVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 73 - protein, 63 aa, Unknown
  LILRB1 hinge domain
YGSQSSKPYLLTHPSDPLELVVSGPSGGPSSPTTGPTSTSGPEDQPLTPTGSDPQSGLGRHLG

SEQ ID NO: 74 - protein, 23 aa, Unknown
  LILRB1 transmembrane domain
VVIGILVAVILLLLLLLLLFLIL

SEQ ID NO: 75 - protein, 740 aa, Homo sapiens
MRQTLPLLLLTVLRPSWADPPQEKVPLFRVTQQGPWGSSGSNATDSPCEGLPAADATALTLANRNLERLPGCLPRTLRSLDASHNLLRALSTSELGHLEQLQVLTLRHNRIAALRWGPGGPAGLHTLDLSYNQLAALPPCTGPALSSLRALALAGNPLRALQPRAFACFPALQLLNLSCTALGRGAQGGIAEAAFAGEDGAPLVTLEVLDLSGTFLERVESGWIRDLPKLTSLYLRKMPRLTTLEGDIFKMTPNLQQLDCQDSPALASVATHIFQDTPHLQVLLFQNCNLSSFPPWTLDSSQVLSINLFGNPLTCSCDLSWLLTDAKRTVLSRAADTMCAPAAGSSGPFSASLSLSQLPGVCQSDQSTTLGASHPPCFNRSTYAQGTTVAPSAAPATRPAGDQQSVSKAPNVGSRTIAAWPHSDAREGTAPSTTNSVAGHSNSSVFPRAASTTRTQHRGEHAPELVLEPDISAASTPLASKLLGPFPTSWDRSISSPQPGQRTHATPQAPNPSLSEGEIPVLLLDDYSEEEEGRKEEVGTPHQDVPCDYHPCKHLQTPCAELQRRWRCRCPGLSGEDTIPDPPRLQGVTETTDTSALVHWCAPNSVVHGYQIRYSAEGWAGNQSVVGVIYATARQHPLYGLSPGTTYRVCVLAANRAGLSQPRSSGWRSPCAAFTTKPSFALLLSGLCAASGLLLASTVVLSACLCRRGQTLGLQRCDTHLVAYKNPAFDDYPLGLQTVS

SEQ ID NO: 76 - protein, 320 aa, Homo sapiens
MGLPWGQPHLGLQMLLLALNCLRPSLSLGEWGSWMDASSQTQGAGGPAGVIGPWAPAPLRLGEAAPGTPTPVSVAHLLSPVATELVPYTPQITAWDLEGKVTATTFSLEQPRCVFDGLASASDTVWLVVAFSNASRGFQNPETLADIPASPQLLTDGHYMTLPLSPDQLPCGDPMAGSGGAPVLRVGHDHGCHQQPFCNAPLPGPGPYREDPRIHRHLARAAKWQHDRHYLHPLFSGRPPTLGLLGSLYHALLQPVVAGGGPGAAADRLLHGQALHDPPHPTQRGRHTAGGLQAWPGPPPQPQPLAWPLCMGLGEMGRRE

SEQ ID NO: 77 - protein, 276 aa, Homo sapiens
MGLPWGQPHLGLQMLLLALNCLRPSLSLELVPYTPQITAWDLEGKVTATTFSLEQPRCVFDGLASASDTVWLVVAFSNASRGFQNPETLADIPASPQLLTDGHYMTLPLSPDQLPCGDPMAGSGGAPVLRVGHDHGCHQQPFCNAPLPGPGPYRVKFLLMDTRGSPRAETKWSDPITLHQGKTPGSIDTWPGRRSGSMIVITSILSSLAGLLLLAFLAASTMRFSSLWWPEEAPEQLRIGSFMGKRYMTHHIPPSEAATLPVGCKPGLDPLPSLSP

SEQ ID NO: 78 - protein, 265 aa, Homo sapiens
MGLPWGQPHLGLQMLLLALNCLRPSLSLELVPYTPQITAWDLEGKVTATTFSLEQPRCVFDGLASASDTVWLVVAFSNASRGFQNPETLADIPASPQLLTDGHYMTLPLSPDQLPCGDPMAGSGGAPVLRVGHDHGCHQQPFCNAPLPGPGPYREDPRIHRHLARAAKWQHDRHYLHPLFSGRPPTLGLLGSLYHALLQPVVAGGGPGAAADRLLHGQALHDPPHPTQRGRHTAGGLQAWPGPPPQPQPLAWPLCMGLGEMGRRE

SEQ ID NO: 79 - protein, 276 aa, Homo sapiens
MGLPWGQPHLGLQMLLLALNCLRPSLSLELVPYTPQITAWDLEGKVTATTFSLEQPRCVFDGLASASDTVWLVVAFSNASRGFQNPETLADIPASPQLLTDGHYMTLPLSPDQLPCGDPMAGSGGAPVLRVGHDHGCHQQPFCNAPLPGPGPYRVKFLLMDTRGSPRAETKWSDPITLHQGKTPGSIDTWPGRRSGSMIVITSILSSLAGLLLLAFLAASTMRFSSLWWPEEAPEQLRIGSFMGKRYMTHHIPPREAATLPVGCKPGLDPLPSLSP

SEQ ID NO: 80 - protein, 239 aa, Artificial Sequence
  MSLN scFv domain
QVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEI

SEQ ID NO: 81 - protein, 64 aa, Unknown
  Hinge (iTIM hinge)
YGSQSSKPYLLTHPSDPLELVVSGPSGGPSSPTTGPTSTSGPEDQPLTPTGSDPQSGLGRHLGV

SEQ ID NO: 82 - protein, 44 aa, Unknown
  Short hinge 2
VVSGPSGGPSSPTTGPTSTSGPEDQPLTPTGSDPQSGLGRHLGV

SEQ ID NO: 83 - protein, 67 aa, Unknown
  Long hinge 1
AGSGGSGGSGGSPVPSTPPTPSPSTPPTPSPSGGSGNSSGSGGSPVPSTPPTPSPSTPPTPSPSASV

SEQ ID NO: 84 - protein, 75 aa, Unknown
  Long hinge 2
AGSGGSGGSGGSPVPSTPPTNSSSTPPTPSPSPVPSTPPTNSSSTPPTPSPSPVPSTPPTNSSSTPPTPSPSASV

SEQ ID NO: 85 - protein, 407 aa, Artificial Sequence
  PA2.1.14 (VL:VH) scFv LIR1 sHTICD
TEFTLTISSLQPDDFATYYCFQGSHVPRTFGQGTKVEVKGGGGSGGGGSGGGGSGGQVQLVQSGAEVKKPGSSVKVSCKASGYTFTSYHIHWVRQAPGQGLEWIGWIYPGNVNTEYNEKFKGKATITADESTNTAYMELSSLRSEDTAVYYCAREEITYAMDYWGQGTLVTVSSVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 86 - protein, 500 aa, Artificial Sequence
  PA2.1.14 (VL:VH) scFv LIR1 HTICD
DIQMTQSPSTLSASVGDRVTITCRSSQSIVHSNGNTYLEWYQQKPGKAPKLLIYKVSNRFSGVPARFSGSGSGTEFTLTISSLQPDDFATYYCFQGSHVPRTFGQGTKVEVKGGGGSGGGGSGGGGSGGQVQLVQSGAEVKKPGSSVKVSCKASGYTFTSYHIHWVRQAPGQGLEWIGWIYPGNVNTEYNEKFKGKATITADESTNTAYMELSSLRSEDTAVYYCAREEITYAMDYWGQGTLVTVSSYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 87 - protein, 462 aa, Artificial Sequence
  MSLN_SsI CD8_HT 41BB CD3z
QVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEITTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 88 - protein, 480 aa, Artificial Sequence
  PA2.1.14 scFv LIR1 sHTICD
QVQLVQSGAEVKKPGSSVKVSCKASGYTFTSYHIHWVRQAPGQGLEWIGWIYPGNVNTEYNEKFKGKATITADESTNTAYMELSSLRSEDTAVYYCAREEITYAMDYWGQGTLVTVSSGGGGSGGGGSGGGGSGGDIQMTQSPSTLSASVGDRVTITCRSSQSIVHSNGNTYLEWYQQKPGKAPKLLIYKVSNRFSGVPARFSGSGSGTEFTLTISSLQPDDFATYYCFQGSHVPRTFGQGTKVEVKVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 89 - protein, 500 aa, Artificial Sequence
  PA2.1.14 scFv LIR1 HTICD
QVQLVQSGAEVKKPGSSVKVSCKASGYTFTSYHIHWVRQAPGQGLEWIGWIYPGNVNTEYNEKFKGKATITADESTNTAYMELSSLRSEDTAVYYCAREEITYAMDYWGQGTLVTVSSGGGGSGGGGSGGGGSGGDIQMTQSPSTLSASVGDRVTITCRSSQSIVHSNGNTYLEWYQQKPGKAPKLLIYKVSNRFSGVPARFSGSGSGTEFTLTISSLQPDDFATYYCFQGSHVPRTFGQGTKVEVKYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 90 - protein, 32 aa, Unknown
  Hinge (truncated)
TTGPTSTSGPEDQPLTPTGSDPQSGLGRHLGV

SEQ ID NO: 91 - protein, 85 aa, Unknown
  2X short hinge
VVSGPSGGPSSPTTGPTSTSGPEDQPLTPTGSDPQSGLGRHVVSGPSGGPSSPTTGPTSTSGPEDQPLTPTGSDPQSGLGRHLGV

SEQ ID NO: 92 - protein, 7 aa, Artificial Sequence
  anti-HLA-A*11 CDR-H1
SGGYYWS

SEQ ID NO: 93 - protein, 7 aa, Artificial Sequence
  anti-HLA-A*11 CDR-H1
TSGVGVG

SEQ ID NO: 94 - protein, 5 aa, Artificial Sequence
  anti-HLA-A*11 CDR-H1
SYAMH

SEQ ID NO: 95 - protein, 5 aa, Artificial Sequence
  anti-HLA-A*11 CDR-H1
SYDMH

SEQ ID NO: 96 - protein, 5 aa, Artificial Sequence
  anti-HLA-A*11 CDR-H1
SYWMH

SEQ ID NO: 97 - protein, 16 aa, Artificial Sequence
  anti-HLA-A*11 CDR-H2
YIYYSGSTYYNPSLKS

SEQ ID NO: 98 - protein, 16 aa, Artificial Sequence
  anti-HLA-A*11 CDR-H2
LIYWNDDKRYSPSLKS

SEQ ID NO: 99 - protein, 17 aa, Artificial Sequence
  anti-HLA-A*11 CDR-H2
WINAGNGNTKYSQKFQG

SEQ ID NO: 100 - protein, 16 aa, Artificial Sequence
  anti-HLA-A*11 CDR-H2
AIGTAGDTYYPGSVKG

SEQ ID NO: 101 - protein, 17 aa, Artificial Sequence
  anti-HLA-A*11 CDR-H2
RINSDGSSTSYADSVKG

SEQ ID NO: 102 - protein, 9 aa, Artificial Sequence
  anti-HLA-A*11 CDR-H3
HYYYYSMDV

SEQ ID NO: 103 - protein, 9 aa, Artificial Sequence
  anti-HLA-A*11 CDR-H3
HYYYYYLDV

SEQ ID NO: 104 - protein, 8 aa, Artificial Sequence
  anti-HLA-A*11 CDR-H3
HYYYYMDV

SEQ ID NO: 105 - protein, 9 aa, Artificial Sequence
  anti-HLA-A*11 CDR-H3
HYYYYYMDV

SEQ ID NO: 106 - protein, 9 aa, Artificial Sequence
  anti-HLA-A*11 CDR-H3
KTTSFYFDY

SEQ ID NO: 107 - protein, 10 aa, Artificial Sequence
  anti-HLA-A*11 CDR-H3
RHMRLSCFDY

SEQ ID NO: 108 - protein, 12 aa, Artificial Sequence
  anti-HLA-A*11 CDR-H3
EGNGANPDAFDI

SEQ ID NO: 109 - protein, 11 aa, Artificial Sequence
  anti-HLA-A*11 CDR-H3
DLPGSYWYFDL

SEQ ID NO: 110 - protein, 10 aa, Artificial Sequence
  anti-HLA-A*11 CDR-H3
GVLLYNWFDP

SEQ ID NO: 111 - protein, 11 aa, Artificial Sequence
  anti-HLA-A*11 CDR1 LC
RASQSISSYLN

SEQ ID NO: 112 - protein, 7 aa, Artificial Sequence
  anti-HLA-A*11 CDR2 LC
AASSLQS

SEQ ID NO: 113 - protein, 9 aa, Artificial Sequence
  anti-HLA-A*11 CDR3 LC
QQSYSTPLT

SEQ ID NO: 114 - protein, 243 aa, Artificial Sequence
  HLA-A*11 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARHYYYYSMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 115 - protein, 244 aa, Artificial Sequence
  HLA-A*11 antigen binding domain
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHRHMRLSCFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 116 - protein, 245 aa, Artificial Sequence
  HLA-A*11 antigen binding domain
QVQLVQSGAEVKKPGASVKVSCKASGYTFTSYAMHWVRQAPGQRLEWMGWINAGNGNTKYSQKFQGRVTITRDTSASTAYMELSSLRSEDTAVYYCAREGNGANPDAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 117 - protein, 243 aa, Artificial Sequence
  HLA-A*11 antigen binding domain
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARDLPGSYWYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 118 - protein, 243 aa, Artificial Sequence
  HLA-A*11 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARHYYYYYLDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 119 - protein, 243 aa, Artificial Sequence
  HLA-A*11 antigen binding domain
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCCLGVLLYNWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 120 - protein, 242 aa, Artificial Sequence
  HLA-A*11 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARHYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 121 - protein, 243 aa, Artificial Sequence
  HLA-A*11 antigen binding domain
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHKTTSFYFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 122 - protein, 243 aa, Artificial Sequence
  HLA-A*11 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARHYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 123 - DNA, 729 bp, Artificial Sequence
  HLA-A*11 antigen binding domain
caggtgcagctgcaggaaagcggccctggcctggtgaaacccagccagaccctgagcctgacctgcacagtgtccggcggctcgatcagcagcggcggctactactggtcctggatcagacagccccctggcaagggcctggaatggatcggctacatctactacagcggcagcacctactacaaccccagcctgaagtccagagtgaccatcagcgtggacaccagcaagaaccagttcagcctgaagctgagcagcgtgacagccgccgacaccgctgtgtattactgtgcgagacactactactactactccatggacgtctggggcaaagggaccacggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 124 - DNA, 732 bp, Artificial Sequence
  HLA-A*11 antigen binding domain
cagatcaccctgaaagagtccggccccaccctggtgaaacccacccagaccctgaccctgacatgcaccttcagcggcttcagcctgagcacctctggcgtgggcgtgggctggatcagacagcctcccggcaaggccctggaatggctggccctgatctactggaacgacgacaagcggtacagccccagcctgaagtcccggctgaccatcaccaaggacacctcgaagaaccaggtggtgctgaccatgacaaacatggaccccgtggacaccgccacatattactgtgcacacagacacatgcgtttaagctgttttgactactggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 125 - DNA, 735 bp, Artificial Sequence
  HLA-A*11 antigen binding domain
caggtgcagctggtgcagtctggcgccgaagtgaagaaacctggcgcctccgtgaaggtgtcctgcaaggccagcggctacaccttcaccagctacgccatgcactgggttcgacaggcccctggccagagactggaatggatgggctggatcaacgccggcaacggcaacaccaagtacagccagaaattccagggcagagtgaccatcacccgggacaccagcgccagcaccgcctacatggaactgagcagcctgcggagcgaggacaccgctgtgtattactgtgcgagagaaggaaatggtgccaaccctgatgcttttgatatctggggccaagggacaatggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 126 - DNA, 729 bp, Artificial Sequence
  HLA-A*11 antigen binding domain
gaagtgcagctggtggaaagcggcggaggcctggtgcagcctggcggcagcctgagactgtcttgcgccgccagcggcttcaccttcagcagctacgacatgcactgggtccgccaggccaccggcaagggactggaatgggtgtccgccatcggcacagccggcgacacttactaccccggcagcgtgaagggccggttcaccatcagcagagagaacgccaagaacagcctgtacctgcagatgaacagccttcgagccggcgataccgccgtgtattactgtgcaagagatctccctggtagctactggtacttcgatctctggggccgtggcaccctggtcactgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 127 - DNA, 729 bp, Artificial Sequence
  HLA-A*11 antigen binding domain
caggtgcagctgcaggaaagcggccctggcctggtgaaacccagccagaccctgagcctgacctgcacagtgtccggcggctcgatcagcagcggcggctactactggtcctggatcagacagccccctggcaagggcctggaatggatcggctacatctactacagcggcagcacctactacaaccccagcctgaagtccagagtgaccatcagcgtggacaccagcaagaaccagttcagcctgaagctgagcagcgtgacagccgccgacaccgctgtgtattactgtgcgagacactactactactactacctggacgtctggggcaaagggaccacggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 128 - DNA, 729 bp, Artificial Sequence
  HLA-A*11 antigen binding domain
gaagtgcagctggtggaaagcggcggaggcctggtgcagcctggcggcagcctgagactgtcttgcgccgccagcggcttcaccttcagcagctactggatgcactgggtccgccaggcccctggcaagggactggtctgggtgtctcgaatcaacagcgacggcagcagcaccagctacgccgacagcgtgaagggccggttcaccatcagccgggacaacgccaagaacaccctgtacctgcagatgaacagcctgcgggccgaggacaccgccgtgtattactgttgtttgggtgttttattatacaactggttcgacccctggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 129 - DNA, 726 bp, Artificial Sequence
  HLA-A*11 antigen binding domain
caggtgcagctgcaggaaagcggccctggcctggtgaaacccagccagaccctgagcctgacctgcacagtgtccggcggctcgatcagcagcggcggctactactggtcctggatcagacagccccctggcaagggcctggaatggatcggctacatctactacagcggcagcacctactacaaccccagcctgaagtccagagtgaccatcagcgtggacaccagcaagaaccagttcagcctgaagctgagcagcgtgacagccgccgacaccgctgtgtattactgtgcgagacactactactactacatggacgtctggggcaaagggaccacggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 130 - DNA, 729 bp, Artificial Sequence
  HLA-A*11 antigen binding domain
cagatcaccctgaaagagtccggccccaccctggtgaaacccacccagaccctgaccctgacatgcaccttcagcggcttcagcctgagcacctctggcgtgggcgtgggctggatcagacagcctcccggcaaggccctggaatggctggccctgatctactggaacgacgacaagcggtacagccccagcctgaagtcccggctgaccatcaccaaggacacctcgaagaaccaggtggtgctgaccatgacaaacatggaccccgtggacaccgccacatattactgtgcacacaaaacgacgtcgttttactttgactactggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 131 - DNA, 729 bp, Artificial Sequence
  HLA-A*11 antigen binding domain
caggtgcagctgcaggaaagcggccctggcctggtgaaacccagccagaccctgagcctgacctgcacagtgtccggcggctcgatcagcagcggcggctactactggtcctggatcagacagccccctggcaagggcctggaatggatcggctacatctactacagcggcagcacctactacaaccccagcctgaagtccagagtgaccatcagcgtggacaccagcaagaaccagttcagcctgaagctgagcagcgtgacagccgccgacaccgctgtgtattactgtgcgagacactactactactactacatggacgtctggggcaaagggaccacggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 132 - protein, 119 aa, Artificial Sequence
  anti-HLA-A*11 heavy chain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARHYYYYSMDVWGKGTTVTVSS

SEQ ID NO: 133 - protein, 120 aa, Artificial Sequence
  anti-HLA-A*11 heavy chain
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHRHMRLSCFDYWGQGTLVTVSS

SEQ ID NO: 134 - protein, 121 aa, Artificial Sequence
  anti-HLA-A*11 heavy chain
QVQLVQSGAEVKKPGASVKVSCKASGYTFTSYAMHWVRQAPGQRLEWMGWINAGNGNTKYSQKFQGRVTITRDTSASTAYMELSSLRSEDTAVYYCAREGNGANPDAFDIWGQGTMVTVSS

SEQ ID NO: 135 - protein, 119 aa, Artificial Sequence
  anti-HLA-A*11 heavy chain
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARDLPGSYWYFDLWGRGTLVTVSS

SEQ ID NO: 136 - protein, 119 aa, Artificial Sequence
  anti-HLA-A*11 heavy chain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARHYYYYYLDVWGKGTTVTVSS

SEQ ID NO: 137 - protein, 119 aa, Artificial Sequence
  anti-HLA-A*11 heavy chain
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCCLGVLLYNWFDPWGQGTLVTVSS

SEQ ID NO: 138 - protein, 118 aa, Artificial Sequence
  anti-HLA-A*11 heavy chain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARHYYYYMDVWGKGTTVTVSS

SEQ ID NO: 139 - protein, 119 aa, Artificial Sequence
  anti-HLA-A*11 heavy chain
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHKTTSFYFDYWGQGTLVTVSS

SEQ ID NO: 140 - protein, 119 aa, Artificial Sequence
  anti-HLA-A*11 heavy chain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARHYYYYYMDVWGKGTTVTVSS

SEQ ID NO: 141 - protein, 107 aa, Artificial Sequence [sequence omitted]

SEQ ID NO: 142 - DNA, 357 bp, Artificial Sequence
  anti-HLA-A*11 heavy chain
caggtgcagctgcaggaaagcggccctggcctggtgaaacccagccagaccctgagcctgacctgcacagtgtccggcggctcgatcagcagcggcggctactactggtcctggatcagacagccccctggcaagggcctggaatggatcggctacatctactacagcggcagcacctactacaaccccagcctgaagtccagagtgaccatcagcgtggacaccagcaagaaccagttcagcctgaagctgagcagcgtgacagccgccgacaccgctgtgtattactgtgcgagacactactactactactccatggacgtctggggcaaagggaccacggtcaccgtgtcctca

SEQ ID NO: 143 - DNA, 360 bp, Artificial Sequence
  anti-HLA-A*11 heavy chain
cagatcaccctgaaagagtccggccccaccctggtgaaacccacccagaccctgaccctgacatgcaccttcagcggcttcagcctgagcacctctggcgtgggcgtgggctggatcagacagcctcccggcaaggccctggaatggctggccctgatctactggaacgacgacaagcggtacagccccagcctgaagtcccggctgaccatcaccaaggacacctcgaagaaccaggtggtgctgaccatgacaaacatggaccccgtggacaccgccacatattactgtgcacacagacacatgcgtttaagctgttttgactactggggccagggaaccctggtcaccgtgtcctca

SEQ ID NO: 144 - DNA, 363 bp, Artificial Sequence
  anti-HLA-A*11 heavy chain
caggtgcagctggtgcagtctggcgccgaagtgaagaaacctggcgcctccgtgaaggtgtcctgcaaggccagcggctacaccttcaccagctacgccatgcactgggttcgacaggcccctggccagagactggaatggatgggctggatcaacgccggcaacggcaacaccaagtacagccagaaattccagggcagagtgaccatcacccgggacaccagcgccagcaccgcctacatggaactgagcagcctgcggagcgaggacaccgctgtgtattactgtgcgagagaaggaaatggtgccaaccctgatgcttttgatatctggggccaagggacaatggtcaccgtgtcctca

SEQ ID NO: 145 - DNA, 357 bp, Artificial Sequence
  anti-HLA-A*11 heavy chain
gaagtgcagctggtggaaagcggcggaggcctggtgcagcctggcggcagcctgagactgtcttgcgccgccagcggcttcaccttcagcagctacgacatgcactgggtccgccaggccaccggcaagggactggaatgggtgtccgccatcggcacagccggcgacacttactaccccggcagcgtgaagggccggttcaccatcagcagagagaacgccaagaacagcctgtacctgcagatgaacagccttcgagccggcgataccgccgtgtattactgtgcaagagatctccctggtagctactggtacttcgatctctggggccgtggcaccctggtcactgtgtcctca

SEQ ID NO: 146 - DNA, 357 bp, Artificial Sequence
  anti-HLA-A*11 heavy chain
caggtgcagctgcaggaaagcggccctggcctggtgaaacccagccagaccctgagcctgacctgcacagtgtccggcggctcgatcagcagcggcggctactactggtcctggatcagacagccccctggcaagggcctggaatggatcggctacatctactacagcggcagcacctactacaaccccagcctgaagtccagagtgaccatcagcgtggacaccagcaagaaccagttcagcctgaagctgagcagcgtgacagccgccgacaccgctgtgtattactgtgcgagacactactactactactacctggacgtctggggcaaagggaccacggtcaccgtgtcctca

SEQ ID NO: 147 - DNA, 357 bp, Artificial Sequence
  anti-HLA-A*11 heavy chain
gaagtgcagctggtggaaagcggcggaggcctggtgcagcctggcggcagcctgagactgtcttgcgccgccagcggcttcaccttcagcagctactggatgcactgggtccgccaggcccctggcaagggactggtctgggtgtctcgaatcaacagcgacggcagcagcaccagctacgccgacagcgtgaagggccggttcaccatcagccgggacaacgccaagaacaccctgtacctgcagatgaacagcctgcgggccgaggacaccgccgtgtattactgttgtttgggtgttttattatacaactggttcgacccctggggccagggaaccctggtcaccgtgtcctca

SEQ ID NO: 148 - DNA, 354 bp, Artificial Sequence
  anti-HLA-A*11 heavy chain
caggtgcagctgcaggaaagcggccctggcctggtgaaacccagccagaccctgagcctgacctgcacagtgtccggcggctcgatcagcagcggcggctactactggtcctggatcagacagccccctggcaagggcctggaatggatcggctacatctactacagcggcagcacctactacaaccccagcctgaagtccagagtgaccatcagcgtggacaccagcaagaaccagttcagcctgaagctgagcagcgtgacagccgccgacaccgctgtgtattactgtgcgagacactactactactacatggacgtctggggcaaagggaccacggtcaccgtgtcctca

SEQ ID NO: 149 - DNA, 357 bp, Artificial Sequence
  anti-HLA-A*11 heavy chain
cagatcaccctgaaagagtccggccccaccctggtgaaacccacccagaccctgaccctgacatgcaccttcagcggcttcagcctgagcacctctggcgtgggcgtgggctggatcagacagcctcccggcaaggccctggaatggctggccctgatctactggaacgacgacaagcggtacagccccagcctgaagtcccggctgaccatcaccaaggacacctcgaagaaccaggtggtgctgaccatgacaaacatggaccccgtggacaccgccacatattactgtgcacacaaaacgacgtcgttttactttgactactggggccagggaaccctggtcaccgtgtcctca

SEQ ID NO: 150 - DNA, 357 bp, Artificial Sequence
  anti-HLA-A*11 heavy chain
caggtgcagctgcaggaaagcggccctggcctggtgaaacccagccagaccctgagcctgacctgcacagtgtccggcggctcgatcagcagcggcggctactactggtcctggatcagacagccccctggcaagggcctggaatggatcggctacatctactacagcggcagcacctactacaaccccagcctgaagtccagagtgaccatcagcgtggacaccagcaagaaccagttcagcctgaagctgagcagcgtgacagccgccgacaccgctgtgtattactgtgcgagacactactactactactacatggacgtctggggcaaagggaccacggtcaccgtgtcctca

SEQ ID NO: 151 - DNA, 321 bp, Artificial Sequence
  anti-HLA-A*11 light chain
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 152 - protein, 17 aa, Artificial Sequence
  linker
GGGGSGGGGSGGGGSGG

SEQ ID NO: 153 - protein, 66 aa, Unknown
  encodes signal sequence
ATGGACATGAGGGTCCCCGCTCAGCTCCTGGGGCTCCTGCTACTCTGGCTCCGAGGTGCCAGATGT

SEQ ID NO: 154 - protein, 245 aa, Artificial Sequence
  MSLN scFv domain
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDLPKLRNFHIWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 155 - protein, 248 aa, Artificial Sequence
  MSLN scFv domain
EVQLVESGGGLVQPGGSLRLSCAASGFTFSSYAMHWVRQAPGKGLEYVSAISSNGGSTYYANSVKGRFTISRDNSKNTLYLQMGSLRAEDMAVYYCASLEYHGFRQYGLRYWHWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 156 - protein, 247 aa, Artificial Sequence
  MSLN scFv domain
QLQLQESGSGLVKPSQTLSLTCAVSGGSISSGGYSWSWIRQPPGKGLEWIGYIYHSGSTYYNPSLKSRVTISVDRSKNQFSLKLSSVTAADTAVYYCASIKFWFAGINYFFPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 157 - protein, 243 aa, Artificial Sequence
  MSLN scFv domain
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCASGFLGMGSNFIWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 158 - protein, 243 aa, Artificial Sequence
  MSLN scFv domain
QVQLQESGPGLVKPSQTLSLTCTVSGGSISSGGYYWSWIRQHPGKGLEWIGYIYYSGSTYYNPSLKSLVTISVDTSKNQFSLKLSSVTAADTAVYYCASGDRARYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 159 - protein, 247 aa, Artificial Sequence
  MSLN scFv domain
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARYPRGYHQMVDAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 160 - protein, 250 aa, Artificial Sequence
  MSLN scFv domain
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARVRFLAARTTIPEANFLWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 161 - protein, 242 aa, Artificial Sequence
  MSLN scFv domain
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARVLSRARFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 162 - protein, 241 aa, Artificial Sequence
  MSLN scFv domain
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARLRGRVFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 163 - protein, 247 aa, Artificial Sequence
  MSLN scFv domain
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARIKFTSFLYVHGFLWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 164 - protein, 246 aa, Artificial Sequence
  MSLN scFv domain
QVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARGQRWLYLGGIRRHWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 165 - protein, 244 aa, Artificial Sequence
  MSLN scFv domain
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAREWIPSRPYYFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 166 - protein, 244 aa, Artificial Sequence
  MSLN scFv domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARESTGTGAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 167 - protein, 246 aa, Artificial Sequence
  MSLN scFv domain
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCARERYRRVLHWYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 168 - protein, 240 aa, Artificial Sequence
  MSLN scFv domain
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCAREPDAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 169 - protein, 246 aa, Artificial Sequence
  MSLN scFv domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREHMGTIPYYFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 170 - protein, 244 aa, Artificial Sequence
  MSLN scFv domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREEFGYGDVLYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 171 - protein, 244 aa, Artificial Sequence
  MSLN scFv domain
QVQLQESGPGLVKPSQTLSLTCTVSGGSISSGDYYWSWIRQPPGKGLEWIGYIYYSGSTYYNPSLKSRVTISVDTSKNQFSLKLSSVTAADTAVYYCAREDVVKGAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 172 - protein, 245 aa, Artificial Sequence
  MSLN scFv domain
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCAREDFSHKLGYFQHWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 173 - protein, 238 aa, Artificial Sequence
  MSLN scFv domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDYDYVWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 174 - protein, 244 aa, Artificial Sequence
  MSLN scFv domain
QVQLQESGPGLVKPSQTLSLTCTVSGGSISSGDYYWSWIRQPPGKGLEWIGYIYYSGSTYYNPSLKSRVTISVDTSKNQFSLKLSSVTAADTAVYYCARDRRDWDWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 175 - protein, 243 aa, Artificial Sequence
  MSLN scFv domain
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARDQQALKYRVDWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 176 - protein, 242 aa, Artificial Sequence
  MSLN scFv domain
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDLTLGCFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 177 - protein, 242 aa, Artificial Sequence
  MSLN scFv domain
EVQLVESGGGLVQPGGSLRLSCAASGFTVSSNYMSWVRQAPGKGLEWVSVIYSGGSTYYADSVKGRFTISRDNSKNTLYLQMNSLRAEDTAVYYCARDGSNSWYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 178 - protein, 242 aa, Artificial Sequence
  MSLN scFv domain
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARAFLFLSFSVWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 179 - protein, 245 aa, Artificial Sequence
  MSLN scFv domain
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKGIFYSSKEDFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 180 - protein, 248 aa, Artificial Sequence
  MSLN scFv domain
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKDIWIFYSSNPKPTVYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 181 - protein, 246 aa, Artificial Sequence
  MSLN scFv domain
QVQLVQSGSELKKPGASVKVSCKASGYTFTSYAMNWVRQAPGQGLEWMGWINTNTGNPTYAQGFTGRFVFSFDTSVSTAYLQICSLKAEDTAVYYCARKDQTLTYGNWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 182 - protein, 242 aa, Artificial Sequence
  MSLN scFv domain
QVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCARDHYERGLYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 183 - protein, 242 aa, Artificial Sequence
  MSLN scFv domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARYMYNWYFDLWGRGTLVTVSSGGGGSGGGGSGGGGSGGDIQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIK

SEQ ID NO: 184 - protein, 241 aa, Artificial Sequence
  MSLN scFv domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDRRPAFDIWGQGTMVTVSSGGGGSGGGGSGGGGSGGDIQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIK

SEQ ID NO: 185 - protein, 243 aa, Artificial Sequence
  MSLN scFv domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAVHLKRRPYFDYWGQGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIK

SEQ ID NO: 186 - protein, 242 aa, Artificial Sequence
  MSLN scFv domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASVHKKPIFDYWGQGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIK

SEQ ID NO: 187 - protein, 242 aa, Artificial Sequence
  MSLN scFv domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASTSRRCTFQHWGQGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIK

SEQ ID NO: 188 - protein, 242 aa, Artificial Sequence
  MSLN scFv domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASTSPRPLFQHWGQGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIK

SEQ ID NO: 189 - protein, 244 aa, Artificial Sequence
  MSLN scFv domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASPYQVRGVYFDYWGQGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIK

SEQ ID NO: 190 - protein, 244 aa, Artificial Sequence
  MSLN scFv domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASPYKKRRTVFDYWGQGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIK

SEQ ID NO: 191 - protein, 243 aa, Artificial Sequence
  MSLN scFv domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASLQRGLALFQHWGQGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIK

SEQ ID NO: 192 - protein, 242 aa, Artificial Sequence
  MSLN scFv domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASILSVPYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIK

SEQ ID NO: 193 - protein, 247 aa, Artificial Sequence
  MSLN scFv domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASGWIRVPLRLPLFQHWGQGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIK

SEQ ID NO: 194 - protein, 242 aa, Artificial Sequence
  MSLN scFv domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARVTIFAIFDIWGQGTMVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIK

SEQ ID NO: 195 - protein, 243 aa, Artificial Sequence
  MSLN scFv domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARVGRGFVHFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIK

SEQ ID NO: 196 - protein, 244 aa, Artificial Sequence
  MSLN scFv domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARTSRGLCVLFDYWGQGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIK

SEQ ID NO: 197 - protein, 244 aa, Artificial Sequence
  MSLN scFv domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARSGPSSYWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIK

SEQ ID NO: 198 - protein, 244 aa, Artificial Sequence
  MSLN scFv domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARNIYMGGIWFDPWGQGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIK

SEQ ID NO: 199 - protein, 243 aa, Artificial Sequence
  MSLN scFv domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARLTVRTGAFDIWGQGTMVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIK

SEQ ID NO: 200 - protein, 243 aa, Artificial Sequence
  MSLN scFv domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARLRTAHLDFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIK

SEQ ID NO: 201 - protein, 243 aa, Artificial Sequence
  MSLN scFv domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLIFPVVFDYWGQGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIK

SEQ ID NO: 202 - protein, 246 aa, Artificial Sequence
  MSLN scFv domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDGYRKYGYVFFDIWGQGTMVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIK

SEQ ID NO: 203 - protein, 246 aa, Artificial Sequence
  MSLN scFv domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDGRYRRFWHAFDIWGQGTMVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIK

SEQ ID NO: 204 - protein, 242 aa, Artificial Sequence
  MSLN scFv domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARAHIRGYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIK

SEQ ID NO: 205 - protein, 245 aa, Artificial Sequence
  MSLN scFv domain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCATWMGGGGRWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNNYPLTFGGGTKVEIK

SEQ ID NO: 206 - protein, 243 aa, Artificial Sequence
  MSLN scFv domain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARTSRTTWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNNYPLTFGGGTKVEIK

SEQ ID NO: 207 - protein, 245 aa, Artificial Sequence
  MSLN scFv domain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKWMGGGGRLYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNNYPLTFGGGTKVEIK

SEQ ID NO: 208 - protein, 244 aa, Artificial Sequence
  MSLN scFv domain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKWGGRLYWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNNYPLTFGGGTKVEIK

SEQ ID NO: 209 - protein, 243 aa, Artificial Sequence
  MSLN scFv domain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVIRQLWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNNYPLTFGGGTKVEIK

SEQ ID NO: 210 - protein, 243 aa, Artificial Sequence
  MSLN scFv domain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVFANSWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNNYPLTFGGGTKVEIK

SEQ ID NO: 211 - protein, 243 aa, Artificial Sequence
  MSLN scFv domain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVDRTTWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNNYPLTFGGGTKVEIK

SEQ ID NO: 212 - protein, 246 aa, Artificial Sequence
  MSLN scFv domain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKRWGKDGPYWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNNYPLTFGGGTKVEIK

SEQ ID NO: 213 - protein, 246 aa, Artificial Sequence
  MSLN scFv domain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKRRDSYGPYWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNNYPLTFGGGTKVEIK

SEQ ID NO: 214 - protein, 245 aa, Artificial Sequence
  MSLN scFv domain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKNRPPPGYWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNNYPLTFGGGTKVEIK

SEQ ID NO: 215 - protein, 243 aa, Artificial Sequence
  MSLN scFv domain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGRRFSWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNNYPLTFGGGTKVEIK

SEQ ID NO: 216 - protein, 121 aa, Artificial Sequence
  heavy chain variable fragment
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDLPKLRNFHIWGQGTLVTVSS

SEQ ID NO: 217 - protein, 124 aa, Artificial Sequence
  heavy chain variable fragment
EVQLVESGGGLVQPGGSLRLSCAASGFTFSSYAMHWVRQAPGKGLEYVSAISSNGGSTYYANSVKGRFTISRDNSKNTLYLQMGSLRAEDMAVYYCASLEYHGFRQYGLRYWHWGQGTLVTVSS

SEQ ID NO: 218 - protein, 123 aa, Artificial Sequence
  heavy chain variable fragment
QLQLQESGSGLVKPSQTLSLTCAVSGGSISSGGYSWSWIRQPPGKGLEWIGYIYHSGSTYYNPSLKSRVTISVDRSKNQFSLKLSSVTAADTAVYYCASIKFWFAGINYFFPWGQGTLVTVSS

SEQ ID NO: 219 - protein, 119 aa, Artificial Sequence
  heavy chain variable fragment
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCASGFLGMGSNFIWGQGTLVTVSS

SEQ ID NO: 220 - protein, 119 aa, Artificial Sequence
  heavy chain variable fragment
QVQLQESGPGLVKPSQTLSLTCTVSGGSISSGGYYWSWIRQHPGKGLEWIGYIYYSGSTYYNPSLKSLVTISVDTSKNQFSLKLSSVTAADTAVYYCASGDRARYFDLWGRGTLVTVSS

SEQ ID NO: 221 - protein, 123 aa, Artificial Sequence
  heavy chain variable fragment
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARYPRGYHQMVDAFDIWGQGTMVTVSS

SEQ ID NO: 222 - protein, 126 aa, Artificial Sequence
  heavy chain variable fragment
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARVRFLAARTTIPEANFLWGQGTLVTVSS

SEQ ID NO: 223 - protein, 118 aa, Artificial Sequence
  heavy chain variable fragment
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARVLSRARFDYWGQGTLVTVSS

SEQ ID NO: 224 - protein, 117 aa, Artificial Sequence
  heavy chain variable fragment
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARLRGRVFDPWGQGTLVTVSS

SEQ ID NO: 225 - protein, 123 aa, Artificial Sequence
  heavy chain variable fragment
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARIKFTSFLYVHGFLWGQGTLVTVSS

SEQ ID NO: 226 - protein, 122 aa, Artificial Sequence
  heavy chain variable fragment
QVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARGQRWLYLGGIRRHWGQGTLVTVSS

SEQ ID NO: 227 - protein, 120 aa, Artificial Sequence
  heavy chain variable fragment
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAREWIPSRPYYFDYWGQGTLVTVSS

SEQ ID NO: 228 - protein, 120 aa, Artificial Sequence
  heavy chain variable fragment
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARESTGTGAFDIWGQGTMVTVSS

SEQ ID NO: 229 - protein, 122 aa, Artificial Sequence
  heavy chain variable fragment
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCARERYRRVLHWYFDLWGRGTLVTVSS

SEQ ID NO: 230 - protein, 116 aa, Artificial Sequence
  heavy chain variable fragment
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCAREPDAFDIWGQGTMVTVSS

SEQ ID NO: 231 - protein, 122 aa, Artificial Sequence
  heavy chain variable fragment
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREHMGTIPYYFDYWGQGTLVTVSS

SEQ ID NO: 232 - protein, 120 aa, Artificial Sequence
  heavy chain variable fragment
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREEFGYGDVLYWGQGTLVTVSS

SEQ ID NO: 233 - protein, 120 aa, Artificial Sequence
  heavy chain variable fragment
QVQLQESGPGLVKPSQTLSLTCTVSGGSISSGDYYWSWIRQPPGKGLEWIGYIYYSGSTYYNPSLKSRVTISVDTSKNQFSLKLSSVTAADTAVYYCAREDVVKGAFDIWGQGTMVTVSS

SEQ ID NO: 234 - protein, 121 aa, Artificial Sequence
  heavy chain variable fragment
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCAREDFSHKLGYFQHWGQGTLVTVSS

SEQ ID NO: 235 - protein, 114 aa, Artificial Sequence
  heavy chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDYDYVWGQGTLVTVSS

SEQ ID NO: 236 - protein, 120 aa, Artificial Sequence
  heavy chain variable fragment
QVQLQESGPGLVKPSQTLSLTCTVSGGSISSGDYYWSWIRQPPGKGLEWIGYIYYSGSTYYNPSLKSRVTISVDTSKNQFSLKLSSVTAADTAVYYCARDRRDWDWFDPWGQGTLVTVSS

SEQ ID NO: 237 - protein, 119 aa, Artificial Sequence
  heavy chain variable fragment
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARDQQALKYRVDWGQGTLVTVSS

SEQ ID NO: 238 - protein, 118 aa, Artificial Sequence
  heavy chain variable fragment
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDLTLGCFDYWGQGTLVTVSS

SEQ ID NO: 239 - protein, 118 aa, Artificial Sequence
  heavy chain variable fragment
EVQLVESGGGLVQPGGSLRLSCAASGFTVSSNYMSWVRQAPGKGLEWVSVIYSGGSTYYADSVKGRFTISRDNSKNTLYLQMNSLRAEDTAVYYCARDGSNSWYFDLWGRGTLVTVSS

SEQ ID NO: 240 - protein, 118 aa, Artificial Sequence
  heavy chain variable fragment
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARAFLFLSFSVWGQGTLVTVSS

SEQ ID NO: 241 - protein, 121 aa, Artificial Sequence
  heavy chain variable fragment
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKGIFYSSKEDFDYWGQGTLVTVSS

SEQ ID NO: 242 - protein, 124 aa, Artificial Sequence
  heavy chain variable fragment
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKDIWIFYSSNPKPTVYWGQGTLVTVSS

SEQ ID NO: 243 - protein, 122 aa, Artificial Sequence
  heavy chain variable fragment
QVQLVQSGSELKKPGASVKVSCKASGYTFTSYAMNWVRQAPGQGLEWMGWINTNTGNPTYAQGFTGRFVFSFDTSVSTAYLQICSLKAEDTAVYYCARKDQTLTYGNWFDPWGQGTLVTVSS

SEQ ID NO: 244 - protein, 118 aa, Artificial Sequence
  heavy chain variable fragment
QVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCARDHYERGLYWGQGTLVTVSS

SEQ ID NO: 245 - protein, 118 aa, Artificial Sequence
  heavy chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARYMYNWYFDLWGRGTLVTVSS

SEQ ID NO: 246 - protein, 117 aa, Artificial Sequence
  heavy chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDRRPAFDIWGQGTMVTVSS

SEQ ID NO: 247 - protein, 119 aa, Artificial Sequence
  heavy chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAVHLKRRPYFDYWGQGTLVTVSS

SEQ ID NO: 248 - protein, 118 aa, Artificial Sequence
  heavy chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASVHKKPIFDYWGQGTLVTVSS

SEQ ID NO: 249 - protein, 118 aa, Artificial Sequence
  heavy chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASTSRRCTFQHWGQGTLVTVSS

SEQ ID NO: 250 - protein, 118 aa, Artificial Sequence
  heavy chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASTSPRPLFQHWGQGTLVTVSS

SEQ ID NO: 251 - protein, 120 aa, Artificial Sequence
  heavy chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASPYQVRGVYFDYWGQGTLVTVSS

SEQ ID NO: 252 - protein, 120 aa, Artificial Sequence
  heavy chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASPYKKRRTVFDYWGQGTLVTVSS

SEQ ID NO: 253 - protein, 119 aa, Artificial Sequence
  heavy chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASLQRGLALFQHWGQGTLVTVSS

SEQ ID NO: 254 - protein, 118 aa, Artificial Sequence
  heavy chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASILSVPYFDLWGRGTLVTVSS

SEQ ID NO: 255 - protein, 123 aa, Artificial Sequence
  heavy chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASGWIRVPLRLPLFQHWGQGTLVTVSS

SEQ ID NO: 256 - protein, 118 aa, Artificial Sequence
  heavy chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARVTIFAIFDIWGQGTMVTVSS

SEQ ID NO: 257 - protein, 119 aa, Artificial Sequence
  heavy chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARVGRGFVHFDLWGRGTLVTVSS

SEQ ID NO: 258 - DNA, 1503 bp, Artificial Sequence
  PA2.1.14 scFv LIR1 HTICD
caggtgcagctggtgcagtctggggctgaggtgaagaagcctgggtcctcagtgaaggtttcctgcaaggcttctggatacaccttcactagctatcatatacattgggtgcgccaggcccccggacaagggcttgagtggatcggatggatctaccctggcaatgttaacacagaatataatgagaagttcaagggcaaagccaccattaccgcggacgaatccacgaacacagcctacatggagctgagcagcctgagatctgaagacacggctgtgtattactgtgcgagggaggaaattacctacgctatggactactggggccagggaaccctggtcaccgtgtcctcaggcggaggtggaagcggagggggaggatctggcggcggaggaagcggaggcgacattcaaatgacccagagcccatccaccctgagcgcatctgtaggtgaccgggtcaccatcacttgtagatccagtcagagtattgtacacagtaatgggaacacctatttggaatggtatcagcagaaaccaggtaaagccccaaaattgctcatctacaaagtctctaacagatttagtggtgtaccagccaggttcagcggttccggaagtggtactgaattcaccctcacgatctcctctctccagccagatgatttcgccacttattactgttttcaaggttcacatgtgccgcgcacattcggtcagggtactaaagtagaagtcaaatacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactag

SEQ ID NO: 259 - protein, 120 aa, Artificial Sequence
  heavy chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARTSRGLCVLFDYWGQGTLVTVSS

SEQ ID NO: 260 - protein, 120 aa, Artificial Sequence
  heavy chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARSGPSSYWYFDLWGRGTLVTVSS

SEQ ID NO: 261 - protein, 120 aa, Artificial Sequence
  heavy chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARNIYMGGIWFDPWGQGTLVTVSS

SEQ ID NO: 262 - protein, 119 aa, Artificial Sequence
  heavy chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARLTVRTGAFDIWGQGTMVTVSS

SEQ ID NO: 263 - protein, 119 aa, Artificial Sequence
  heavy chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARLRTAHLDFDLWGRGTLVTVSS

SEQ ID NO: 264 - protein, 119 aa, Artificial Sequence
  heavy chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLIFPVVFDYWGQGTLVTVSS

SEQ ID NO: 265 - protein, 122 aa, Artificial Sequence
  heavy chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDGYRKYGYVFFDIWGQGTMVTVSS

SEQ ID NO: 266 - protein, 122 aa, Artificial Sequence
  heavy chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDGRYRRFWHAFDIWGQGTMVTVSS

SEQ ID NO: 267 - protein, 118 aa, Artificial Sequence
  heavy chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARAHIRGYFDLWGRGTLVTVSS

SEQ ID NO: 268 - protein, 121 aa, Artificial Sequence
  heavy chain variable fragment
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCATWMGGGGRWYFDLWGRGTLVTVSS

SEQ ID NO: 269 - protein, 119 aa, Artificial Sequence
  heavy chain variable fragment
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARTSRTTWYFDLWGRGTLVTVSS

SEQ ID NO: 270 - protein, 121 aa, Artificial Sequence
  heavy chain variable fragment
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKWMGGGGRLYFDLWGRGTLVTVSS

SEQ ID NO: 271 - protein, 120 aa, Artificial Sequence
  heavy chain variable fragment
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKWGGRLYWYFDLWGRGTLVTVSS

SEQ ID NO: 272 - protein, 119 aa, Artificial Sequence
  heavy chain variable fragment
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVIRQLWYFDLWGRGTLVTVSS

SEQ ID NO: 273 - protein, 119 aa, Artificial Sequence
  heavy chain variable fragment
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVFANSWYFDLWGRGTLVTVSS

SEQ ID NO: 274 - protein, 119 aa, Artificial Sequence
  heavy chain variable fragment
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVDRTTWYFDLWGRGTLVTVSS

SEQ ID NO: 275 - protein, 122 aa, Artificial Sequence
  heavy chain variable fragment
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKRWGKDGPYWYFDLWGRGTLVTVSS

SEQ ID NO: 276 - protein, 122 aa, Artificial Sequence
  heavy chain variable fragment
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKRRDSYGPYWYFDLWGRGTLVTVSS

SEQ ID NO: 277 - protein, 121 aa, Artificial Sequence
  heavy chain variable fragment
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKNRPPPGYWYFDLWGRGTLVTVSS

SEQ ID NO: 278 - protein, 119 aa, Artificial Sequence
  heavy chain variable fragment
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGRRFSWYFDLWGRGTLVTVSS

SEQ ID NO: 279 - protein, 107 aa, Artificial Sequence [sequence omitted]

SEQ ID NO: 280 - protein, 107 aa, Artificial Sequence
  light chain variable fragment
DIQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIK

SEQ ID NO: 281 - protein, 107 aa, Artificial Sequence [sequence omitted]

SEQ ID NO: 282 - protein, 107 aa, Artificial Sequence
  light chain variable fragment
AIQLTQSPSSLSASVGDRVTITCRASQGISSALAWYQQKPGKAPKLLIYDASSLESGVPSRFSGSGSGTDFTLTISSLQPEDFATYYCQQFNNYPLTFGGGTKVEIK

SEQ ID NO: 283 - protein, 42 aa, Unknown
  4-1BB co-stimulatory domain
KRGRKKLLYIFKQPFMRPVQTTQEEDGCSCRFPEEEEGGCEL

SEQ ID NO: 284 - DNA, 126 bp, Unknown
  encodes 4-1BB co-stimulatory domain
aaacggggcagaaagaaactcctgtatatattcaaacaaccatttatgaggccagtacaaactactcaagaggaagatggctgtagctgccgatttccagaagaagaagaaggaggatgtgaactg

SEQ ID NO: 285 - protein, 195 aa, Artificial Sequence
  CAR intracellular domain
RSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 286 - protein, 512 aa, Artificial Sequence
  single chain variable fragment
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDLPKLRNFHIWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 287 - protein, 515 aa, Artificial Sequence
  single chain variable fragment
EVQLVESGGGLVQPGGSLRLSCAASGFTFSSYAMHWVRQAPGKGLEYVSAISSNGGSTYYANSVKGRFTISRDNSKNTLYLQMGSLRAEDMAVYYCASLEYHGFRQYGLRYWHWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 288 - protein, 514 aa, Artificial Sequence
  single chain variable fragment
QLQLQESGSGLVKPSQTLSLTCAVSGGSISSGGYSWSWIRQPPGKGLEWIGYIYHSGSTYYNPSLKSRVTISVDRSKNQFSLKLSSVTAADTAVYYCASIKFWFAGINYFFPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 289 - protein, 510 aa, Artificial Sequence
  single chain variable fragment
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCASGFLGMGSNFIWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 290 - protein, 510 aa, Artificial Sequence
  single chain variable fragment
QVQLQESGPGLVKPSQTLSLTCTVSGGSISSGGYYWSWIRQHPGKGLEWIGYIYYSGSTYYNPSLKSLVTISVDTSKNQFSLKLSSVTAADTAVYYCASGDRARYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 291 - protein, 514 aa, Artificial Sequence
  single chain variable fragment
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARYPRGYHQMVDAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 292 - protein, 517 aa, Artificial Sequence
  single chain variable fragment
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARVRFLAARTTIPEANFLWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 293 - protein, 509 aa, Artificial Sequence
  single chain variable fragment
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARVLSRARFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 294 - protein, 508 aa, Artificial Sequence
  single chain variable fragment
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARLRGRVFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 295 - protein, 514 aa, Artificial Sequence
  single chain variable fragment
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARIKFTSFLYVHGFLWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 296 - protein, 513 aa, Artificial Sequence
  single chain variable fragment
QVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARGQRWLYLGGIRRHWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 297 - protein, 511 aa, Artificial Sequence
  single chain variable fragment
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAREWIPSRPYYFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 298 - protein, 511 aa, Artificial Sequence
  single chain variable fragment
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARESTGTGAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 299 - protein, 513 aa, Artificial Sequence
  single chain variable fragment
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCARERYRRVLHWYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 300 - protein, 507 aa, Artificial Sequence
  single chain variable fragment
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCAREPDAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 301 - protein, 513 aa, Artificial Sequence
  single chain variable fragment
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREHMGTIPYYFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 302 - protein, 511 aa, Artificial Sequence
  single chain variable fragment
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREEFGYGDVLYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 303 - protein, 511 aa, Artificial Sequence
  single chain variable fragment
QVQLQESGPGLVKPSQTLSLTCTVSGGSISSGDYYWSWIRQPPGKGLEWIGYIYYSGSTYYNPSLKSRVTISVDTSKNQFSLKLSSVTAADTAVYYCAREDVVKGAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 304 - protein, 512 aa, Artificial Sequence
  single chain variable fragment
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCAREDFSHKLGYFQHWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 305 - protein, 505 aa, Artificial Sequence
  single chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDYDYVWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 306 - protein, 511 aa, Artificial Sequence
  single chain variable fragment
QVQLQESGPGLVKPSQTLSLTCTVSGGSISSGDYYWSWIRQPPGKGLEWIGYIYYSGSTYYNPSLKSRVTISVDTSKNQFSLKLSSVTAADTAVYYCARDRRDWDWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 307 - protein, 510 aa, Artificial Sequence
  single chain variable fragment
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARDQQALKYRVDWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 308 - protein, 509 aa, Artificial Sequence
  single chain variable fragment
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDLTLGCFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 309 - protein, 509 aa, Artificial Sequence
  single chain variable fragment
EVQLVESGGGLVQPGGSLRLSCAASGFTVSSNYMSWVRQAPGKGLEWVSVIYSGGSTYYADSVKGRFTISRDNSKNTLYLQMNSLRAEDTAVYYCARDGSNSWYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 310 - protein, 509 aa, Artificial Sequence
  single chain variable fragment
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARAFLFLSFSVWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 311 - protein, 512 aa, Artificial Sequence
  single chain variable fragment
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKGIFYSSKEDFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 312 - protein, 515 aa, Artificial Sequence
  single chain variable fragment
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKDIWIFYSSNPKPTVYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 313 - protein, 513 aa, Artificial Sequence
  single chain variable fragment
QVQLVQSGSELKKPGASVKVSCKASGYTFTSYAMNWVRQAPGQGLEWMGWINTNTGNPTYAQGFTGRFVFSFDTSVSTAYLQICSLKAEDTAVYYCARKDQTLTYGNWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 314 - protein, 509 aa, Artificial Sequence
  single chain variable fragment
QVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCARDHYERGLYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 315 - protein, 509 aa, Artificial Sequence
  single chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARYMYNWYFDLWGRGTLVTVSSGGGGSGGGGSGGGGSGGDIQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 316 - protein, 508 aa, Artificial Sequence
  single chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDRRPAFDIWGQGTMVTVSSGGGGSGGGGSGGGGSGGDIQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 317 - protein, 510 aa, Artificial Sequence
  single chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAVHLKRRPYFDYWGQGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 318 - protein, 509 aa, Artificial Sequence
  single chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASVHKKPIFDYWGQGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 319 - protein, 509 aa, Artificial Sequence
  single chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASTSRRCTFQHWGQGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 320 - protein, 509 aa, Artificial Sequence
  single chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASTSPRPLFQHWGQGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 321 - protein, 511 aa, Artificial Sequence
  single chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASPYQVRGVYFDYWGQGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 322 - protein, 511 aa, Artificial Sequence
  single chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASPYKKRRTVFDYWGQGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 323 - protein, 510 aa, Artificial Sequence
  single chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASLQRGLALFQHWGQGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 324 - protein, 509 aa, Artificial Sequence
  single chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASILSVPYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 325 - protein, 514 aa, Artificial Sequence
  single chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASGWIRVPLRLPLFQHWGQGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 326 - protein, 509 aa, Artificial Sequence
  single chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARVTIFAIFDIWGQGTMVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 327 - protein, 510 aa, Artificial Sequence
  single chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARVGRGFVHFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 328 - protein, 511 aa, Artificial Sequence
  single chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARTSRGLCVLFDYWGQGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 329 - protein, 511 aa, Artificial Sequence
  single chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARSGPSSYWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 330 - protein, 511 aa, Artificial Sequence
  single chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARNIYMGGIWFDPWGQGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 331 - protein, 510 aa, Artificial Sequence
  single chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARLTVRTGAFDIWGQGTMVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 332 - protein, 510 aa, Artificial Sequence
  single chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARLRTAHLDFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 333 - protein, 510 aa, Artificial Sequence
  single chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLIFPVVFDYWGQGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 334 - protein, 513 aa, Artificial Sequence
  single chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDGYRKYGYVFFDIWGQGTMVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 335 - protein, 513 aa, Artificial Sequence
  single chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDGRYRRFWHAFDIWGQGTMVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 336 - protein, 509 aa, Artificial Sequence
  single chain variable fragment
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARAHIRGYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 337 - protein, 512 aa, Artificial Sequence
  single chain variable fragment
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCATWMGGGGRWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNNYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 338 - protein, 510 aa, Artificial Sequence
  single chain variable fragment
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARTSRTTWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNNYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 339 - protein, 512 aa, Artificial Sequence
  single chain variable fragment
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKWMGGGGRLYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNNYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 340 - protein, 511 aa, Artificial Sequence
  single chain variable fragment
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKWGGRLYWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNNYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 341 - protein, 510 aa, Artificial Sequence
  single chain variable fragment
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVIRQLWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNNYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 342 - protein, 510 aa, Artificial Sequence
  single chain variable fragment
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVFANSWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNNYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 343 - protein, 510 aa, Artificial Sequence
  single chain variable fragment
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVDRTTWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNNYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 344 - protein, 513 aa, Artificial Sequence
  single chain variable fragment
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKRWGKDGPYWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNNYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 345 - protein, 513 aa, Artificial Sequence
  single chain variable fragment
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKRRDSYGPYWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNNYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 346 - protein, 512 aa, Artificial Sequence
  single chain variable fragment
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKNRPPPGYWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNNYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 347 - protein, 510 aa, Artificial Sequence
  single chain variable fragment
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGRRFSWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNNYPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 348 - protein, 500 aa, Unknown
  inhibitory receptor
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPRTSGGGTKLEIKGGGGSGGGGSGGGGSGGQVQLQQSGPELVKPGASVRISCKASGYTFTSYHIHWVKQRPGQGLEWIGWIYPGNVNTEYNEKFKGKATLTADKSSSTAYMHLSSLTSEDSAVYFCAREEITYAMDYWGQGTSVTVSSYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 349 - DNA, 46 bp, Artificial Sequence
  B2M shRNA
gcactcaaagcttgttaagatcgaaatcttaacaagctttgagtgc

SEQ ID NO: 350 - DNA, 46 bp, Artificial Sequence
  B2M shRNA
gttaacttccaatttacataccgaagtatgtaaattggaagttaac

SEQ ID NO: 351 - protein, 21 aa, Unknown
  T2A self-cleaving polypeptide
GSGEGRGSLLTCGDVEENPGP

SEQ ID NO: 352 - protein, 64 aa, Unknown; identical to SEQ ID NO: 81
  HLA-A*02 scFv LIR-1 inhibitory receptor

SEQ ID NO: 353 - protein, 64 aa, Unknown; identical to SEQ ID NO: 81
  HLA-A*02 scFv LIR-1 inhibitory receptor

SEQ ID NO: 354 - protein, 44 aa, Unknown; identical to SEQ ID NO: 82
  HLA-A*02 scFv LIR-1 inhibitory receptor

SEQ ID NO: 355 - protein, 64 aa, Unknown; identical to SEQ ID NO: 81
  HLA-A*02 scFv LIR-1 inhibitory receptor

SEQ ID NO: 356 - protein, 44 aa, Unknown; identical to SEQ ID NO: 82
  HLA-A*02 scFv LIR-1 inhibitory receptor

SEQ ID NO: 357 - protein, 71 aa, Unknown
  HLA-A*02 scFv LIR-1 inhibitory receptor
SSYGSQSSKPYLLTHPSDPLELVVSGPSGGPSSPTTGPTSTSGPEDQPLTPTGSDPQSGLGRHLGVVIGIL

SEQ ID NO: 358 - protein, 39 aa, Unknown
  HLA-A*02 scFv LIR-1 inhibitory receptor
SSTTGPTSTSGPEDQPLTPTGSDPQSGLGRHLGVVIGIL

SEQ ID NO: 359 - protein, 74 aa, Unknown
  HLA-A*02 scFv LIR-1 inhibitory receptor
SSAGSGGSGGSGGSPVPSTPPTPSPSTPPTPSPSGGSGNSSGSGGSPVPSTPPTPSPSTPPTPSPSASVVIGIL

SEQ ID NO: 360 - protein, 82 aa, Unknown
  HLA-A*02 scFv LIR-1 inhibitory receptor
SSAGSGGSGGSGGSPVPSTPPTNSSSTPPTPSPSPVPSTPPTNSSSTPPTPSPSPVPSTPPTNSSSTPPTPSPSASVVIGIL

SEQ ID NO: 361 - protein, 92 aa, Unknown
  HLA-A*02 scFv LIR-1 inhibitory receptor
SSVVSGPSGGPSSPTTGPTSTSGPEDQPLTPTGSDPQSGLGRHVVSGPSGGPSSPTTGPTSTSGPEDQPLTPTGSDPQSGLGRHLGVVIGIL

SEQ ID NO: 362 - protein, 22 aa, Unknown
  signal sequence
MDMRVPAQLLGLLLLWLRGARC

SEQ ID NO: 363 - DNA, 711 bp, Artificial Sequence
  MSLN scFv domain
caggtgcagctggtgcagtctggggctgaggtggagaagcctggggcctcagtgaaggtctcctgcaaggcttctggatacaccttcaccgactactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgtctggctgggactttgactactggggccagggaaccctggtcaccgtgtcctcaggcggaggtggaagcggagggggaggatctggcggcggaggaagcggaggcgacatcgtgatgacccagtcttcctccctgtctgcatctgtcggagacagagtcaccatcacttgccgggccagtcagagcattaggtactatttaagttggtatcagcagaaaccaggaaaagcccctaagctcctgatctatactgcatccattttacaaaatggggtcccatcaaggttcagtggcagtggatctgggacagatttcactctcaccatcagcagcctgcaacctgaggattttgcaacttattactgcctccagacttacactactccggactttggcccagggaccaaggtggaaatcaaa

SEQ ID NO: 364 - DNA, 738 bp, Artificial Sequence
  MSLN scFv domain
caggtgcagctggtgcagtctggggctgaggtgagggcacctggggcctcagtgaagatttcctgcaaggcttctggattcaccttcagaggctactatatccactgggtgcgacaggcccctggacaagggcttgagtggatgggaatcatcaaccctagtggtggtagcagagcctacgcacagaagttccagggcagggtcaccatgaccagggacacttccacgagcacagtctacatggagctgagcagcctgagatctgacgacacggccatgtattactgtgcgagaaccgcaagttgtggtggtgactgctactaccttgactactggggccagggaaccctggtcaccgtgtcctcaggcggaggtggaagcggagggggaggatctggcggcggaggaagcggaggcgacatccagatgacccagtctcctcccaccctgtctgcatctgtaggagacagagtcaccatcacttgccgggccagtgagaatgttaatatctggttggcctggtatcagcagaaaccagggaaagcccctaagctcctgatctataagtcatccagtttagcaagtggggtcccatcaaggttcagtggcagtggatctggggcagaattcactctcaccatcagcagcctgcagcctgatgattttgcaacttattactgccaacagtatcaaagttaccccctcactttcggcggagggaccaaggtggaaatcaaa

SEQ ID NO: 365 - DNA, 726 bp, Artificial Sequence
  MSLN scFv domain
caggtgcagctggtgcagtctggggctgaggtgaagaagcctggggcctcagtgaaggtttcctgcaaggcttctggatactcattcaccggctacaccatgaactgggtgaggcaggcccctggacaaagacttgagtggatgggacttatcaccccttacaatggtgcttctagctacaaccagaagttcaggggcagggtcacaatcactagagacacgtcagccagcacagcctacatggagctctccagcctgagatctgaagacactgcagtctattactgtgcaagggggggttacgacgggaggggttttgactactggggccagggaaccacggtcaccgtgtcctcaggcggaggtggaagcggagggggaggatctggcggcggaggaagcggaggcgacatccagatgacccagtctccttcaagcttgtctgcatctgtaggagacagggtcaccatcacttgcagtgccagctcaagtgtaagttacatgcactggtatcagcagaaaccaggcaaggcccctaagagattgatctatgacacatccaaattagcaagtggggtcccaagtcgcttcagtggcagtggatctgggaccgaattcactctcaccatcagcagcttgcagcctgaggattttgcaacttattactgccagcagtggagtggttaccctctcacgttcggtcaggggacaaagttggaaatcaaa

SEQ ID NO: 366 - DNA, 726 bp, Artificial Sequence
  MSLN scFv domain
caggtgcagctgcagcagtctgggcctgagctggagaagcctggggcctcagtgaagatttcctgcaaggcttctggatactcattcaccggctacaccatgaactgggtgaagcagagccatggaaaaagccttgagtggattggacttatcaccccttacaatggtgcttctagctacaaccagaagttcaggggcaaggccacattaactgtagacaagtcatccagcacagcctacatggacctcctcagcctgacatctgaagactctgcagtctatttctgtgcaagggggggttacgacgggaggggttttgactactggggccagggaaccacggtcaccgtgtcctcaggcggaggtggaagcggagggggaggatctggcggcggaggaagcggaggcgacatcgagctcacccagtctcctgcaatcatgtctgcatctccaggagagaaggtcaccatgacttgcagtgccagctcaagtgtaagttacatgcactggtatcagcagaaatcaggcacctcccctaagagatggatctatgacacatccaaattggcaagtggggtcccaggtcgcttcagtggcagtggatctgggaactcttactctctcaccatcagcagcgtggaggctgaggatgatgcaacttattactgccagcagtggagtggttaccctctcacgttcggtgctgggacaaagttggaaatcaaa

SEQ ID NO: 367 - DNA, 735 bp, Artificial Sequence
  MSLN scFv domain
gaagtgcagctggtggaaagcggcggaggcctggtgaaacctggcggcagcctgagactgagctgcgccgccagcggcttcaccttctcgaacgcctggatgagctgggtccgccaggcccctggcaagggactggaatgggtcggacggatcaagagcaagaccgacggcggcaccaccgactacgctgcccccgtgaagggccggttcaccatcagccgggacgacagcaagaacaccctgtacctgcagatgaacagcctgaaaaccgaggacaccgccgtgtattactgtaccacagatcttcctaagcttaggaattttcatatttggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 368 - DNA, 744 bp, Artificial Sequence
  MSLN scFv domain
gaagtgcagctggtggaaagcggcggaggcctggtgcagcctggcggcagcctgagactgtcttgcgccgccagcggcttcaccttcagcagctacgccatgcactgggtccgccaggcccctggcaagggactggaatacgtgtccgccatcagctcgaacggcggcagcacctactacgccaacagcgtgaagggccggttcaccatcagccgggacaacagcaagaacaccctgtacctgcagatgggcagcctgcgggccgaggatatggccgtgtattactgtgcgagcctagaataccatggctttcgacaatatgggcttcgttattggcattggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 369 - DNA, 741 bp, Artificial Sequence
  MSLN scFv domain
cagctgcagctccaggaaagcggcagcggcctggtgaaacccagccagaccctgagcctgacctgtgccgtgtccggcggcagcatcagcagcggcggctacagctggtcctggatcagacagccccctggcaagggcctggaatggatcggctacatctaccacagcggctcgacctactacaaccccagcctgaagtccagagtgaccatcagcgtggacagaagcaagaaccagttcagcctgaagctgagcagcgtgacagccgccgacaccgctgtgtattactgtgccagcataaaattctggtttgcggggattaattatttttttccgtggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 370 - DNA, 729 bp, Artificial Sequence
  MSLN scFv domain
gaagtgcagctggtggaaagcggcggaggcctggtgcagcctggcggcagcctgagactgtcttgcgccgccagcggcttcaccttcagcagctactggatgcactgggtccgccaggcccctggcaagggactggtctgggtgtctcgaatcaacagcgacggcagcagcaccagctacgccgacagcgtgaagggccggttcaccatcagccgggacaacgccaagaacaccctgtacctgcagatgaacagcctgcgggccgaggacaccgccgtgtattactgtgcaagcggatttttgggaatgggctcgaattttatttggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 371 - DNA, 729 bp, Artificial Sequence
  MSLN scFv domain
caggtgcagctgcaggaaagcggccctggcctggtgaaacccagccagaccctgagcctgacctgcacagtgtccggcggcagcatcagcagcggcggctactactggtcctggatcagacagcaccccggcaagggcctggaatggatcggctacatctactacagcggcagcacctactacaaccccagcctgaagtccctggtgacaatctccgtcgataccagcaagaaccagttcagcctgaagctgagcagcgtgacagccgccgacaccgctgtgtattactgtgcaagcggggacagggcacggtacttcgatctctggggccgtggcaccctggtcactgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 372 - DNA, 741 bp, Artificial Sequence
  MSLN scFv domain
gaagtgcagctggtggaaagcggcggaggcctggtgcagcctggcggcagcctgagactgtcttgcgccgccagcggcttcaccttcagcagctactggatgcactgggtccgccaggcccctggcaagggactggtctgggtgtctcgaatcaacagcgacggcagcagcaccagctacgccgacagcgtgaagggccggttcaccatcagccgggacaacgccaagaacaccctgtacctgcagatgaacagcctgcgggccgaggacaccgccgtgtattactgtgcaagatatccacgtggatatcatcagatggttgatgcttttgatatctggggccaagggacaatggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 373 - DNA, 750 bp, Artificial Sequence
  MSLN scFv domain
cagctgcagctccaggaaagcggccctggcctggtgaaacccagcgagacactgagcctgacctgcaccgtgtccggcggcagcatcagcagcagcagctactactggggctggatcagacagccccctggcaagggcctggaatggatcggctcgatctactacagcggctccacctactacaaccccagcctgaagtccagagtgaccatcagcgtggacaccagcaagaaccagttcagcctgaagctgagcagcgtgacagccgccgacaccgctgtgtattactgtgcgagagtacgatttttggctgctcgcactactattccggaggcgaattttctttggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 374 - DNA, 726 bp, Artificial Sequence
  MSLN scFv domain
gaagtgcagctggtggaaagcggcggaggcctggtgcagcctggcggcagcctgagactgtcttgcgccgccagcggcttcaccttcagcagctacagcatgaactgggtccgccaggcccctggcaagggactggaatgggtgtcctacatcagcagcagcagctccaccatctactacgccgacagcgtgaagggtcgattcaccatcagccgggacaacgccaagaacagcctgtacctgcagatgaacagcctgcgggccgaggacaccgccgtgtattactgtgcgagagtactctccagggctaggtttgactactggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 375 - DNA, 723 bp, Artificial Sequence
  MSLN scFv domain
gaagtgcagctggtggaaagcggcggaggcctggtgaaacctggcggcagcctgagactgagctgcgccgccagcggcttcaccttcagcagctacagcatgaactgggtccgccaggcccctggcaagggactggaatgggtgtcctcgatcagcagcagcagctcctacatctactacgccgacagcgtgaagggccggttcaccatcagccgggacaacgccaagaacagcctgtacctgcagatgaacagcctgcgggccgaggacaccgccgtgtattactgtgcgagattacgagggagggtgttcgacccctggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 376 - DNA, 741 bp, Artificial Sequence
  MSLN scFv domain
cagctgcagctccaggaaagcggccctggcctggtgaaacccagcgagacactgagcctgacctgcaccgtgtccggcggcagcatcagcagcagcagctactactggggctggatcagacagccccctggcaagggcctggaatggatcggctcgatctactacagcggctccacctactacaaccccagcctgaagtccagagtgaccatcagcgtggacaccagcaagaaccagttcagcctgaagctgagcagcgtgacagccgccgacaccgctgtgtattactgtgcgagaataaaatttaccagctttttatatgttcatggttttctgtggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 377 - DNA, 738 bp, Artificial Sequence
  MSLN scFv domain
caggtgcagctggtgcagtctggcgccgaagtgaagaaacctggcgcctccgtgaaggtgtcctgcaaggccagcggctacaccttcaccagctacgccatgcactgggttcgacaggcccctggccagagactggaatggatgggctggatcaacgccggcaacggcaacaccaagtacagccagaaattccagggcagagtgaccatcacccgggacaccagcgccagcaccgcctacatggaactgagcagcctgcggagcgaggacaccgctgtgtattactgtgcgagaggccagagatggctgtacctcggggggattcgtcggcattggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 378 - DNA, 732 bp, Artificial Sequence
  MSLN scFv domain
caggtgcagctgcaggaaagcggccctggcctggtgaaacccagcgagacactgagcctgacctgcaccgtgtccggcggcagcatcagcagctactactggtcctggatcagacagccccctggcaagggcctggaatggatcggctacatctactacagcggcagcaccaactacaaccccagcctgaagtccagagtgaccatctccgtcgataccagcaagaaccagttcagcctgaagctgagcagcgtgacagccgccgacaccgctgtgtattactgtgcgagagaatggattcccagccgtccgtactactttgactactggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 379 - DNA, 732 bp, Artificial Sequence
  MSLN scFv domain
caggtgcagctgcaggaaagcggccctggcctggtgaaacccagccagaccctgagcctgacctgcacagtgtccggcggctcgatcagcagcggcggctactactggtcctggatcagacagccccctggcaagggcctggaatggatcggctacatctactacagcggcagcacctactacaaccccagcctgaagtccagagtgaccatcagcgtggacaccagcaagaaccagttcagcctgaagctgagcagcgtgacagccgccgacaccgctgtgtattactgtgcgagagaaagtaccggtacaggagcttttgatatctggggccaagggacaatggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 380 - DNA, 738 bp, Artificial Sequence
  MSLN scFv domain
gaagtgcagctggtggaaagcggaggcggagtggttcgacctggcggaagcctgagactgtcttgcgccgccagcggcttcacctttgacgactacggcatgagctgggtccgccaggcccctggcaagggactggaatgggtgtccggcatcaactggaacggcggcagcaccggctacgccgacagcgtgaagggccggttcaccatcagccgggacaacgccaagaacagcctgtacctgcagatgaacagcctgcgggccgaggacaccgccttgtatcactgtgcgagagagaggtacaggcgggtactccactggtacttcgatctctggggccgtggcaccctggtcactgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 381 - DNA, 720 bp, Artificial Sequence
  MSLN scFv domain
caggtgcagctggtgcagtctggcgccgaagtgaagaaacctggcgcctccgtgaaggtgtcctgcaaggccagcggctacaccttcaccagctacgacatcaactgggtccgccaggccaccggacagggcctggaatggatgggctggatgaaccccaacagcggcaacaccggctacgcccagaaattccagggcagagtgaccatgacccggaacacctcgatcagcaccgcctacatggaactgagcagcctgcggagcgaggacaccgctgtgtattactgtgcgagagaaccggatgcttttgatatctggggccaagggacaatggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 382 - DNA, 738 bp, Artificial Sequence
  MSLN scFv domain
caggtgcagctgcaggaaagcggccctggcctggtgaaacccagccagaccctgagcctgacctgcacagtgtccggcggctcgatcagcagcggcggctactactggtcctggatcagacagccccctggcaagggcctggaatggatcggctacatctactacagcggcagcacctactacaaccccagcctgaagtccagagtgaccatcagcgtggacaccagcaagaaccagttcagcctgaagctgagcagcgtgacagccgccgacaccgctgtgtattactgtgcgagagaacatatggggacgattccgtactactttgactactggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 383 - DNA, 732 bp, Artificial Sequence
  MSLN scFv domain
caggtgcagctgcaggaaagcggccctggcctggtgaaacccagccagaccctgagcctgacctgcacagtgtccggcggctcgatcagcagcggcggctactactggtcctggatcagacagccccctggcaagggcctggaatggatcggctacatctactacagcggcagcacctactacaaccccagcctgaagtccagagtgaccatcagcgtggacaccagcaagaaccagttcagcctgaagctgagcagcgtgacagccgccgacaccgctgtgtattactgtgcgagagaagagtttggttatggggacgtcctctactggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 384 - DNA, 732 bp, Artificial Sequence
  MSLN scFv domain
caggtgcagctgcaggaaagcggccctggcctggtgaaacccagccagaccctgagcctgacctgcacagtgtccggcggcagcatcagcagcggcgactactactggtcctggatcagacagccccctggcaagggcctggaatggatcggctacatctactacagcggcagcacctactacaaccccagcctgaagtctcgagtgaccatcagcgtggacaccagcaagaaccagttcagcctgaagctgagcagcgtgacagccgccgacaccgctgtgtattactgtgccagagaggacgtagtcaaaggcgcttttgatatctggggccaagggacaatggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 385 - DNA, 735 bp, Artificial Sequence
  MSLN scFv domain
gaagtgcagctggtggaaagcggcggaggcctggtgcagcctggcggcagcctgagactgtcttgcgccgccagcggcttcaccttcagcagctacagcatgaactgggtccgccaggcccctggcaagggactggaatgggtgtcctacatcagcagcagcagctccaccatctactacgccgacagcgtgaagggtcgattcaccatcagccgggacaacgccaagaacagcctgtacctgcagatgaacagcctgcgggccgaggacaccgccgtgtattactgtgcgagagaagacttctcgcataagctagggtacttccagcactggggccagggcaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 386 - DNA, 714 bp, Artificial Sequence
  MSLN scFv domain
caggtgcagctggtggaaagcggcggaggcctggtgaaacctggcggcagcctgagactgagctgcgccgccagcggcttcaccttcagcgactactacatgagctggatcagacaggcccctggcaagggactggaatgggtgtcctacatcagcagcagcggctcgaccatctactacgccgacagcgtgaagggccggttcaccatcagccgggacaacgccaagaacagcctgtacctgcagatgaacagcctgcgggccgaggacaccgccgtgtattactgtgcgagagattacgattacgtgtggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 387 - DNA, 732 bp, Artificial Sequence
  MSLN scFv domain
caggtgcagctgcaggaaagcggccctggcctggtgaaacccagccagaccctgagcctgacctgcacagtgtccggcggcagcatcagcagcggcgactactactggtcctggatcagacagccccctggcaagggcctggaatggatcggctacatctactacagcggcagcacctactacaaccccagcctgaagtctcgagtgaccatcagcgtggacaccagcaagaaccagttcagcctgaagctgagcagcgtgacagccgccgacaccgctgtgtattactgtgccagagatcgccgtgattgggactggttcgacccctggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 388 - DNA, 729 bp, Artificial Sequence
  MSLN scFv domain
caggtgcagctgcaggaaagcggccctggcctggtgaaacccagcggcaccctgagcctgacctgtgccgtgtctggcggcagcatcagcagcagcaactggtggtcctgggtccgccagcctcccggcaagggcctcgaatggatcggcgagatctaccacagcggcagcaccaactacaaccccagcctgaagtccagagtgaccatcagcgtggacaagagcaagaaccagttcagcctgaagctgagcagcgtgacagccgccgacaccgctgtgtattactgtgcgagagatcagcaggcgttgaaataccgtgtggattggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 389 - DNA, 726 bp, Artificial Sequence
  MSLN scFv domain
caggtgcagctggtgcagtctggcgccgaagtgaagaaacctggcgcctccgtgaaggtgtcctgcaaggccagcggctacaccttcaccagctacggcatcagctgggtccgccaggctcctggacagggactggaatggatgggctggatcagcgcctacaacggcaacaccaactacgcccagaaactgcagggcagagtgaccatgaccaccgacaccagcaccagcaccgcctacatggaacttcgaagcctgagaagcgacgacaccgccgtgtattactgtgcgagagatcttacgctaggatgctttgactactggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 390 - DNA, 726 bp, Artificial Sequence
  MSLN scFv domain
gaagtgcagctggtggaaagcggcggaggcctggtgcagcctggcggcagcctgagactgtcttgcgccgccagcggcttcaccgtgtccagcaactacatgagctgggtccgccaggcccctggcaagggactggaatgggtgtccgtgatctacagcggcggcagcacctactacgccgacagcgtgaagggtcgattcaccatcagccgggacaacagcaagaacaccctgtacctgcagatgaacagcctgcgggccgaggacaccgccgtgtattactgtgcgagagatgggtcaaactcttggtacttcgatctctggggccgtggcaccctggtcactgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 391 - DNA, 726 bp, Artificial Sequence
  MSLN scFv domain
caggtgcagctggtggaaagcggcggaggcgtggtgcagcccggcagaagccttcgactgagctgcgccgccagcggcttcaccttcagcagctacggcatgcactgggtccgccaggcccctggcaagggactggaatgggtggccgtgatttggtacgacggcagcaacaagtactacgccgacagcgtgaagggccggttcaccatcagccgggacaacagcaagaacaccctgtacctgcagatgaacagcctgcgggccgaggacaccgccgtgtattactgtgcgagggcatttttattcctgtctttttcggtttggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 392 - DNA, 735 bp, Artificial Sequence
  MSLN scFv domain
gaagtgcagctggtggaatctggcggcgtggtggtgcagcctggcggcagcctgagactgtcttgcgccgccagcggcttcaccttcgacgactacaccatgcactgggtccgccaggcccctggcaagggactggaatgggtgtccctgatcagctgggacggcggctctacctactacgccgactccgtgaagggccggttcaccatcagccgggacaacagcaagaacagcctgtacctgcagatgaacagcctgcggaccgaggacaccgccttgtattactgtgcaaaagggatattctactcgagtaaagaggattttgactactggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 393 - DNA, 744 bp, Artificial Sequence
  MSLN scFv domain
gaagtgcagctggtggaatctggcggcgtggtggtgcagcctggcggcagcctgagactgtcttgcgccgccagcggcttcaccttcgacgactacaccatgcactgggtccgccaggcccctggcaagggactggaatgggtgtccctgatcagctgggacggcggctctacctactacgccgactccgtgaagggccggttcaccatcagccgggacaacagcaagaacagcctgtacctgcagatgaacagcctgcggaccgaggacaccgccttgtattactgtgcaaaagatatatggatattctactcgagtaatccaaagccgacggtctactggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 394 - DNA, 738 bp, Artificial Sequence
  MSLN scFv domain
caggtgcagctggtgcagagcggcagcgagctgaagaaacctggcgcctccgtgaaggtgtcctgcaaggccagcggctacaccttcaccagctacgccatgaactgggtccgccaggccccaggccagggactggaatggatgggctggatcaacaccaacaccggcaaccccacctacgcccagggcttcaccggcagattcgtgttcagcttcgacaccagcgtgtccaccgcctacctgcagatctgtagcctgaaggccgaggacaccgccgtgtattactgtgcgaggaaggatcagacgctgacctacggaaactggttcgacccctggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 395 - DNA, 726 bp, Artificial Sequence
  MSLN scFv domain
caggtgcagctgcaggaaagcggccctggcctggtgaaacccagcgagacactgagcctgacctgcaccgtgtccggcggctctgtgtccagcggctcctactactggtcctggatcagacagccccctggcaagggcctcgaatggatcggctacatctactacagcggcagcaccaactacaaccccagcctgaagtccagagtgaccatcagcgtggacaccagcaagaaccagttcagcctgaagctgagcagcgtgacagccgccgacaccgctgtgtattactgtgcgagagatcattacgagcgggggctctactggggccagggaaccctggtcaccgtgtcctcaggcggaggtggaagcggagggggaggatctggcggcggaggaagcggaggcgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggcggaacaaaggtggagatcaag

SEQ ID NO: 396 - DNA, 726 bp, Artificial Sequence
  MSLN scFv domain
caggtgcagctggtggaaagcggcggaggcctggtgaaacctggcggcagcctgagactgagctgcgccgccagcggcttcaccttcagcgactactacatgagctggatcagacaggcccctggcaagggactggaatgggtgtcctacatcagcagcagcggctcgaccatctactacgccgacagcgtgaagggccggttcaccatcagccgggacaacgccaagaacagcctgtacctgcagatgaacagcctgcgggccgaggacaccgccgtgtattactgtgcgagatatatgtataactggtacttcgatctctggggccgtggcaccctggtcactgtgtcctcaggcggaggtggaagcggagggggaggatctggcggcggaggaagcggaggcgacatccagatgacccagagccccagcagcgtgtccgccagcgtgggcgatcgagtgaccatcacctgtcgggcctcccagggcatcagcagctggctggcctggtatcagcagaagcccggcaaggcccccaagctgctgatctacgccgccagcagcctgcagagcggcgtgccaagcagattcagcggcagcggctccggcaccgacttcaccctgaccatcagctccctgcagcccgaggacttcgccacctactactgccagcaggctaacagtttccctctcactttcggcggcggaacaaaggtggagatcaag

SEQ ID NO: 397 - DNA, 723 bp, Artificial Sequence
  MSLN scFv domain
caggtgcagctggtggaaagcggcggaggcctggtgaaacctggcggcagcctgagactgagctgcgccgccagcggcttcaccttcagcgactactacatgagctggatcagacaggcccctggcaagggactggaatgggtgtcctacatcagcagcagcggctcgaccatctactacgccgacagcgtgaagggccggttcaccatcagccgggacaacgccaagaacagcctgtacctgcagatgaacagcctgcgggccgaggacaccgccgtgtattactgtgcgagagatcgaaggcctgcttttgatatctggggccaagggacaatggtcaccgtgtcctcaggcggaggtggaagcggagggggaggatctggcggcggaggaagcggaggcgacatccagatgacccagagccccagcagcgtgtccgccagcgtgggcgatcgagtgaccatcacctgtcgggcctcccagggcatcagcagctggctggcctggtatcagcagaagcccggcaaggcccccaagctgctgatctacgccgccagcagcctgcagagcggcgtgccaagcagattcagcggcagcggctccggcaccgacttcaccctgaccatcagctccctgcagcccgaggacttcgccacctactactgccagcaggctaacagtttccctctcactttcggcggcggaacaaaggtggagatcaag

SEQ ID NO: 398 - DNA, 729 bp, Artificial Sequence
  MSLN scFv domain
caggtgcagctggtggaaagcggcggaggcctggtgaaacctggcggcagcctgagactgagctgcgccgccagcggcttcaccttcagcgactactacatgagctggatcagacaggcccctggcaagggactggaatgggtgtcctacatcagcagcagcggctcgaccatctactacgccgacagcgtgaagggccggttcaccatcagccgggacaacgccaagaacagcctgtacctgcagatgaacagcctgcgggccgaggacaccgccgtgtattactgtgcggtacatttgaaacgacgtccctactttgactactggggccagggaaccctggtcaccgtgtcctcaggcggaggtggaagcggagggggaggatctggcggcggaggaagcggaggcgccatccagctgacccagagccccagcagcctgagcgccagcgtgggcgatagagtgaccatcacctgtcgcgccagccagggcatcagcagcgctctggcctggtatcagcagaagcccggcaaggcccccaagctgctgatctacgacgccagctccctggaaagcggcgtgcccagcagattcagcggcagcggctccggcaccgacttcaccctgaccatcagcagcctgcagcccgaggacttcgccacctactactgccagcagtttaatagttaccctctcactttcggcggcggaacaaaggtggagatcaag

SEQ ID NO: 399 - DNA, 726 bp, Artificial Sequence
  MSLN scFv domain
caggtgcagctggtggaaagcggcggaggcctggtgaaacctggcggcagcctgagactgagctgcgccgccagcggcttcaccttcagcgactactacatgagctggatcagacaggcccctggcaagggactggaatgggtgtcctacatcagcagcagcggctcgaccatctactacgccgacagcgtgaagggccggttcaccatcagccgggacaacgccaagaacagcctgtacctgcagatgaacagcctgcgggccgaggacaccgccgtgtattactgtgcgagcgtacataagaaacccatctttgactactggggccagggaaccctggtcaccgtgtcctcaggcggaggtggaagcggagggggaggatctggcggcggaggaagcggaggcgccatccagctgacccagagccccagcagcctgagcgccagcgtgggcgatagagtgaccatcacctgtcgcgccagccagggcatcagcagcgctctggcctggtatcagcagaagcccggcaaggcccccaagctgctgatctacgacgccagctccctggaaagcggcgtgcccagcagattcagcggcagcggctccggcaccgacttcaccctgaccatcagcagcctgcagcccgaggacttcgccacctactactgccagcagtttaatagttaccctctcactttcggcggcggaacaaaggtggagatcaag

SEQ ID NO: 400 - DNA, 726 bp, Artificial Sequence
  MSLN scFv domain
caggtgcagctggtggaaagcggcggaggcctggtgaaacctggcggcagcctgagactgagctgcgccgccagcggcttcaccttcagcgactactacatgagctggatcagacaggcccctggcaagggactggaatgggtgtcctacatcagcagcagcggctcgaccatctactacgccgacagcgtgaagggccggttcaccatcagccgggacaacgccaagaacagcctgtacctgcagatgaacagcctgcgggccgaggacaccgccgtgtattactgtgcgagtaccagtcggcgctgtaccttccagcactggggccagggcaccctggtcaccgtgtcctcaggcggaggtggaagcggagggggaggatctggcggcggaggaagcggaggcgccatccagctgacccagagccccagcagcctgagcgccagcgtgggcgatagagtgaccatcacctgtcgcgccagccagggcatcagcagcgctctggcctggtatcagcagaagcccggcaaggcccccaagctgctgatctacgacgccagctccctggaaagcggcgtgcccagcagattcagcggcagcggctccggcaccgacttcaccctgaccatcagcagcctgcagcccgaggacttcgccacctactactgccagcagtttaatagttaccctctcactttcggcggcggaacaaaggtggagatcaag

SEQ ID NO: 401 - DNA, 726 bp, Artificial Sequence
  MSLN scFv domain
caggtgcagctggtggaaagcggcggaggcctggtgaaacctggcggcagcctgagactgagctgcgccgccagcggcttcaccttcagcgactactacatgagctggatcagacaggcccctggcaagggactggaatgggtgtcctacatcagcagcagcggctcgaccatctactacgccgacagcgtgaagggccggttcaccatcagccgggacaacgccaagaacagcctgtacctgcagatgaacagcctgcgggccgaggacaccgccgtgtattactgtgcgagtaccagcccgcgtcctctcttccagcactggggccagggcaccctggtcaccgtgtcctcaggcggaggtggaagcggagggggaggatctggcggcggaggaagcggaggcgccatccagctgacccagagccccagcagcctgagcgccagcgtgggcgatagagtgaccatcacctgtcgcgccagccagggcatcagcagcgctctggcctggtatcagcagaagcccggcaaggcccccaagctgctgatctacgacgccagctccctggaaagcggcgtgcccagcagattcagcggcagcggctccggcaccgacttcaccctgaccatcagcagcctgcagcccgaggacttcgccacctactactgccagcagtttaatagttaccctctcactttcggcggcggaacaaaggtggagatcaag

SEQ ID NO: 402 - DNA, 732 bp, Artificial Sequence
  MSLN scFv domain
caggtgcagctggtggaaagcggcggaggcctggtgaaacctggcggcagcctgagactgagctgcgccgccagcggcttcaccttcagcgactactacatgagctggatcagacaggcccctggcaagggactggaatgggtgtcctacatcagcagcagcggctcgaccatctactacgccgacagcgtgaagggccggttcaccatcagccgggacaacgccaagaacagcctgtacctgcagatgaacagcctgcgggccgaggacaccgccgtgtattactgtgcgagcccttaccaagtccgaggagtctactttgactactggggccagggaaccctggtcaccgtgtcctcaggcggaggtggaagcggagggggaggatctggcggcggaggaagcggaggcgccatccagctgacccagagccccagcagcctgagcgccagcgtgggcgatagagtgaccatcacctgtcgcgccagccagggcatcagcagcgctctggcctggtatcagcagaagcccggcaaggcccccaagctgctgatctacgacgccagctccctggaaagcggcgtgcccagcagattcagcggcagcggctccggcaccgacttcaccctgaccatcagcagcctgcagcccgaggacttcgccacctactactgccagcagtttaatagttaccctctcactttcggcggcggaacaaaggtggagatcaag

SEQ ID NO: 403 - DNA, 732 bp, Artificial Sequence
  MSLN scFv domain
caggtgcagctggtggaaagcggcggaggcctggtgaaacctggcggcagcctgagactgagctgcgccgccagcggcttcaccttcagcgactactacatgagctggatcagacaggcccctggcaagggactggaatgggtgtcctacatcagcagcagcggctcgaccatctactacgccgacagcgtgaagggccggttcaccatcagccgggacaacgccaagaacagcctgtacctgcagatgaacagcctgcgggccgaggacaccgccgtgtattactgtgcgagcccctataagaaacgacgaacggtctttgactactggggccagggaaccctggtcaccgtgtcctcaggcggaggtggaagcggagggggaggatctggcggcggaggaagcggaggcgccatccagctgacccagagccccagcagcctgagcgccagcgtgggcgatagagtgaccatcacctgtcgcgccagccagggcatcagcagcgctctggcctggtatcagcagaagcccggcaaggcccccaagctgctgatctacgacgccagctccctggaaagcggcgtgcccagcagattcagcggcagcggctccggcaccgacttcaccctgaccatcagcagcctgcagcccgaggacttcgccacctactactgccagcagtttaatagttaccctctcactttcggcggcggaacaaaggtggagatcaag

SEQ ID NO: 404 - DNA, 729 bp, Artificial Sequence
  MSLN scFv domain
caggtgcagctggtggaaagcggcggaggcctggtgaaacctggcggcagcctgagactgagctgcgccgccagcggcttcaccttcagcgactactacatgagctggatcagacaggcccctggcaagggactggaatgggtgtcctacatcagcagcagcggctcgaccatctactacgccgacagcgtgaagggccggttcaccatcagccgggacaacgccaagaacagcctgtacctgcagatgaacagcctgcgggccgaggacaccgccgtgtattactgtgcgtctttacagcgcgggctggccctcttccagcactggggccagggcaccctggtcaccgtgtcctcaggcggaggtggaagcggagggggaggatctggcggcggaggaagcggaggcgccatccagctgacccagagccccagcagcctgagcgccagcgtgggcgatagagtgaccatcacctgtcgcgccagccagggcatcagcagcgctctggcctggtatcagcagaagcccggcaaggcccccaagctgctgatctacgacgccagctccctggaaagcggcgtgcccagcagattcagcggcagcggctccggcaccgacttcaccctgaccatcagcagcctgcagcccgaggacttcgccacctactactgccagcagtttaatagttaccctctcactttcggcggcggaacaaaggtggagatcaag

SEQ ID NO: 405 - DNA, 726 bp, Artificial Sequence
  MSLN scFv domain
caggtgcagctggtggaaagcggcggaggcctggtgaaacctggcggcagcctgagactgagctgcgccgccagcggcttcaccttcagcgactactacatgagctggatcagacaggcccctggcaagggactggaatgggtgtcctacatcagcagcagcggctcgaccatctactacgccgacagcgtgaagggccggttcaccatcagccgggacaacgccaagaacagcctgtacctgcagatgaacagcctgcgggccgaggacaccgccgtgtattactgtgctagcatattgtcagttccgtacttcgatctctggggccgtggcaccctggtcactgtgtcctcaggcggaggtggaagcggagggggaggatctggcggcggaggaagcggaggcgccatccagctgacccagagccccagcagcctgagcgccagcgtgggcgatagagtgaccatcacctgtcgcgccagccagggcatcagcagcgctctggcctggtatcagcagaagcccggcaaggcccccaagctgctgatctacgacgccagctccctggaaagcggcgtgcccagcagattcagcggcagcggctccggcaccgacttcaccctgaccatcagcagcctgcagcccgaggacttcgccacctactactgccagcagtttaatagttaccctctcactttcggcggcggaacaaaggtggagatcaag

SEQ ID NO: 406 - DNA, 741 bp, Artificial Sequence
  MSLN scFv domain
caggtgcagctggtggaaagcggcggaggcctggtgaaacctggcggcagcctgagactgagctgcgccgccagcggcttcaccttcagcgactactacatgagctggatcagacaggcccctggcaagggactggaatgggtgtcctacatcagcagcagcggctcgaccatctactacgccgacagcgtgaagggccggttcaccatcagccgggacaacgccaagaacagcctgtacctgcagatgaacagcctgcgggccgaggacaccgccgtgtattactgtgcgagtgggtggattcgtgtacctttacgattgcccctcttccagcactggggccagggcaccctggtcaccgtgtcctcaggcggaggtggaagcggagggggaggatctggcggcggaggaagcggaggcgccatccagctgacccagagccccagcagcctgagcgccagcgtgggcgatagagtgaccatcacctgtcgcgccagccagggcatcagcagcgctctggcctggtatcagcagaagcccggcaaggcccccaagctgctgatctacgacgccagctccctggaaagcggcgtgcccagcagattcagcggcagcggctccggcaccgacttcaccctgaccatcagcagcctgcagcccgaggacttcgccacctactactgccagcagtttaatagttaccctctcactttcggcggcggaacaaaggtggagatcaag

SEQ ID NO: 407 - DNA, 726 bp, Artificial Sequence
  MSLN scFv domain
caggtgcagctggtggaaagcggcggaggcctggtgaaacctggcggcagcctgagactgagctgcgccgccagcggcttcaccttcagcgactactacatgagctggatcagacaggcccctggcaagggactggaatgggtgtcctacatcagcagcagcggctcgaccatctactacgccgacagcgtgaagggccggttcaccatcagccgggacaacgccaagaacagcctgtacctgcagatgaacagcctgcgggccgaggacaccgccgtgtattactgtgcgagagtaaccatatttgcgatatttgatatctggggccaagggacaatggtcaccgtgtcctcaggcggaggtggaagcggagggggaggatctggcggcggaggaagcggaggcgccatccagctgacccagagccccagcagcctgagcgccagcgtgggcgatagagtgaccatcacctgtcgcgccagccagggcatcagcagcgctctggcctggtatcagcagaagcccggcaaggcccccaagctgctgatctacgacgccagctccctggaaagcggcgtgcccagcagattcagcggcagcggctccggcaccgacttcaccctgaccatcagcagcctgcagcccgaggacttcgccacctactactgccagcagtttaatagttaccctctcactttcggcggcggaacaaaggtggagatcaag

SEQ ID NO: 408 - DNA, 729 bp, Artificial Sequence
  MSLN scFv domain
caggtgcagctggtggaaagcggcggaggcctggtgaaacctggcggcagcctgagactgagctgcgccgccagcggcttcaccttcagcgactactacatgagctggatcagacaggcccctggcaagggactggaatgggtgtcctacatcagcagcagcggctcgaccatctactacgccgacagcgtgaagggccggttcaccatcagccgggacaacgccaagaacagcctgtacctgcagatgaacagcctgcgggccgaggacaccgccgtgtattactgtgcgagagtgggacgtggattcgttcattttgatctctggggccgtggcaccctggtcactgtgtcctcaggcggaggtggaagcggagggggaggatctggcggcggaggaagcggaggcgccatccagctgacccagagccccagcagcctgagcgccagcgtgggcgatagagtgaccatcacctgtcgcgccagccagggcatcagcagcgctctggcctggtatcagcagaagcccggcaaggcccccaagctgctgatctacgacgccagctccctggaaagcggcgtgcccagcagattcagcggcagcggctccggcaccgacttcaccctgaccatcagcagcctgcagcccgaggacttcgccacctactactgccagcagtttaatagttaccctctcactttcggcggcggaacaaaggtggagatcaag

SEQ ID NO: 409 - DNA, 732 bp, Artificial Sequence
  MSLN scFv domain
caggtgcagctggtggaaagcggcggaggcctggtgaaacctggcggcagcctgagactgagctgcgccgccagcggcttcaccttcagcgactactacatgagctggatcagacaggcccctggcaagggactggaatgggtgtcctacatcagcagcagcggctcgaccatctactacgccgacagcgtgaagggccggttcaccatcagccgggacaacgccaagaacagcctgtacctgcagatgaacagcctgcgggccgaggacaccgccgtgtattactgtgcgaggacgtcaagaggtttgtgtgttttatttgactactggggccagggaaccctggtcaccgtgtcctcaggcggaggtggaagcggagggggaggatctggcggcggaggaagcggaggcgccatccagctgacccagagccccagcagcctgagcgccagcgtgggcgatagagtgaccatcacctgtcgcgccagccagggcatcagcagcgctctggcctggtatcagcagaagcccggcaaggcccccaagctgctgatctacgacgccagctccctggaaagcggcgtgcccagcagattcagcggcagcggctccggcaccgacttcaccctgaccatcagcagcctgcagcccgaggacttcgccacctactactgccagcagtttaatagttaccctctcactttcggcggcggaacaaaggtggagatcaag

SEQ ID NO: 410 - DNA, 732 bp, Artificial Sequence
  MSLN scFv domain
caggtgcagctggtggaaagcggcggaggcctggtgaaacctggcggcagcctgagactgagctgcgccgccagcggcttcaccttcagcgactactacatgagctggatcagacaggcccctggcaagggactggaatgggtgtcctacatcagcagcagcggctcgaccatctactacgccgacagcgtgaagggccggttcaccatcagccgggacaacgccaagaacagcctgtacctgcagatgaacagcctgcgggccgaggacaccgccgtgtattactgtgcgagaagtgggcccagtagctactggtacttcgatctctggggccgtggcaccctggtcactgtgtcctcaggcggaggtggaagcggagggggaggatctggcggcggaggaagcggaggcgccatccagctgacccagagccccagcagcctgagcgccagcgtgggcgatagagtgaccatcacctgtcgcgccagccagggcatcagcagcgctctggcctggtatcagcagaagcccggcaaggcccccaagctgctgatctacgacgccagctccctggaaagcggcgtgcccagcagattcagcggcagcggctccggcaccgacttcaccctgaccatcagcagcctgcagcccgaggacttcgccacctactactgccagcagtttaatagttaccctctcactttcggcggcggaacaaaggtggagatcaag

SEQ ID NO: 411 - DNA, 732 bp, Artificial Sequence
  MSLN scFv domain
caggtgcagctggtggaaagcggcggaggcctggtgaaacctggcggcagcctgagactgagctgcgccgccagcggcttcaccttcagcgactactacatgagctggatcagacaggcccctggcaagggactggaatgggtgtcctacatcagcagcagcggctcgaccatctactacgccgacagcgtgaagggccggttcaccatcagccgggacaacgccaagaacagcctgtacctgcagatgaacagcctgcgggccgaggacaccgccgtgtattactgtgcgagaaacatttacatgggcgggatctggttcgacccctggggccagggaaccctggtcaccgtgtcctcaggcggaggtggaagcggagggggaggatctggcggcggaggaagcggaggcgccatccagctgacccagagccccagcagcctgagcgccagcgtgggcgatagagtgaccatcacctgtcgcgccagccagggcatcagcagcgctctggcctggtatcagcagaagcccggcaaggcccccaagctgctgatctacgacgccagctccctggaaagcggcgtgcccagcagattcagcggcagcggctccggcaccgacttcaccctgaccatcagcagcctgcagcccgaggacttcgccacctactactgccagcagtttaatagttaccctctcactttcggcggcggaacaaaggtggagatcaag

SEQ ID NO: 412 - DNA, 729 bp, Artificial Sequence
  MSLN scFv domain
caggtgcagctggtggaaagcggcggaggcctggtgaaacctggcggcagcctgagactgagctgcgccgccagcggcttcaccttcagcgactactacatgagctggatcagacaggcccctggcaagggactggaatgggtgtcctacatcagcagcagcggctcgaccatctactacgccgacagcgtgaagggccggttcaccatcagccgggacaacgccaagaacagcctgtacctgcagatgaacagcctgcgggccgaggacaccgccgtgtattactgtgcgagacttacagtccgcactggagcttttgatatctggggccaagggacaatggtcaccgtgtcctcaggcggaggtggaagcggagggggaggatctggcggcggaggaagcggaggcgccatccagctgacccagagccccagcagcctgagcgccagcgtgggcgatagagtgaccatcacctgtcgcgccagccagggcatcagcagcgctctggcctggtatcagcagaagcccggcaaggcccccaagctgctgatctacgacgccagctccctggaaagcggcgtgcccagcagattcagcggcagcggctccggcaccgacttcaccctgaccatcagcagcctgcagcccgaggacttcgccacctactactgccagcagtttaatagttaccctctcactttcggcggcggaacaaaggtggagatcaag

SEQ ID NO: 413 - DNA, 729 bp, Artificial Sequence
  MSLN scFv domain
caggtgcagctggtggaaagcggcggaggcctggtgaaacctggcggcagcctgagactgagctgcgccgccagcggcttcaccttcagcgactactacatgagctggatcagacaggcccctggcaagggactggaatgggtgtcctacatcagcagcagcggctcgaccatctactacgccgacagcgtgaagggccggttcaccatcagccgggacaacgccaagaacagcctgtacctgcagatgaacagcctgcgggccgaggacaccgccgtgtattactgtgcgagactaagaactgcccacctggacttcgatctctggggccgtggcaccctggtcactgtgtcctcaggcggaggtggaagcggagggggaggatctggcggcggaggaagcggaggcgccatccagctgacccagagccccagcagcctgagcgccagcgtgggcgatagagtgaccatcacctgtcgcgccagccagggcatcagcagcgctctggcctggtatcagcagaagcccggcaaggcccccaagctgctgatctacgacgccagctccctggaaagcggcgtgcccagcagattcagcggcagcggctccggcaccgacttcaccctgaccatcagcagcctgcagcccgaggacttcgccacctactactgccagcagtttaatagttaccctctcactttcggcggcggaacaaaggtggagatcaag

SEQ ID NO: 414 - DNA, 729 bp, Artificial Sequence
  MSLN scFv domain
caggtgcagctggtggaaagcggcggaggcctggtgaaacctggcggcagcctgagactgagctgcgccgccagcggcttcaccttcagcgactactacatgagctggatcagacaggcccctggcaagggactggaatgggtgtcctacatcagcagcagcggctcgaccatctactacgccgacagcgtgaagggccggttcaccatcagccgggacaacgccaagaacagcctgtacctgcagatgaacagcctgcgggccgaggacaccgccgtgtattactgtgcgagagatctcatatttccagtagtctttgactactggggccagggaaccctggtcaccgtgtcctcaggcggaggtggaagcggagggggaggatctggcggcggaggaagcggaggcgccatccagctgacccagagccccagcagcctgagcgccagcgtgggcgatagagtgaccatcacctgtcgcgccagccagggcatcagcagcgctctggcctggtatcagcagaagcccggcaaggcccccaagctgctgatctacgacgccagctccctggaaagcggcgtgcccagcagattcagcggcagcggctccggcaccgacttcaccctgaccatcagcagcctgcagcccgaggacttcgccacctactactgccagcagtttaatagttaccctctcactttcggcggcggaacaaaggtggagatcaag

SEQ ID NO: 415 - DNA, 738 bp, Artificial Sequence
  MSLN scFv domain
caggtgcagctggtggaaagcggcggaggcctggtgaaacctggcggcagcctgagactgagctgcgccgccagcggcttcaccttcagcgactactacatgagctggatcagacaggcccctggcaagggactggaatgggtgtcctacatcagcagcagcggctcgaccatctactacgccgacagcgtgaagggccggttcaccatcagccgggacaacgccaagaacagcctgtacctgcagatgaacagcctgcgggccgaggacaccgccgtgtattactgtgcgagagatggatatcgcaaatatggttacgtattttttgatatctggggccaagggacaatggtcaccgtgtcctcaggcggaggtggaagcggagggggaggatctggcggcggaggaagcggaggcgccatccagctgacccagagccccagcagcctgagcgccagcgtgggcgatagagtgaccatcacctgtcgcgccagccagggcatcagcagcgctctggcctggtatcagcagaagcccggcaaggcccccaagctgctgatctacgacgccagctccctggaaagcggcgtgcccagcagattcagcggcagcggctccggcaccgacttcaccctgaccatcagcagcctgcagcccgaggacttcgccacctactactgccagcagtttaatagttaccctctcactttcggcggcggaacaaaggtggagatcaag

SEQ ID NO: 416 - DNA, 738 bp, Artificial Sequence
  MSLN scFv domain
caggtgcagctggtggaaagcggcggaggcctggtgaaacctggcggcagcctgagactgagctgcgccgccagcggcttcaccttcagcgactactacatgagctggatcagacaggcccctggcaagggactggaatgggtgtcctacatcagcagcagcggctcgaccatctactacgccgacagcgtgaagggccggttcaccatcagccgggacaacgccaagaacagcctgtacctgcagatgaacagcctgcgggccgaggacaccgccgtgtattactgtgcgagagatgggaggtacaggcggttctggcatgcttttgatatctggggccaagggacaatggtcaccgtgtcctcaggcggaggtggaagcggagggggaggatctggcggcggaggaagcggaggcgccatccagctgacccagagccccagcagcctgagcgccagcgtgggcgatagagtgaccatcacctgtcgcgccagccagggcatcagcagcgctctggcctggtatcagcagaagcccggcaaggcccccaagctgctgatctacgacgccagctccctggaaagcggcgtgcccagcagattcagcggcagcggctccggcaccgacttcaccctgaccatcagcagcctgcagcccgaggacttcgccacctactactgccagcagtttaatagttaccctctcactttcggcggcggaacaaaggtggagatcaag

SEQ ID NO: 417 - DNA, 726 bp, Artificial Sequence
  MSLN scFv domain
caggtgcagctggtggaaagcggcggaggcctggtgaaacctggcggcagcctgagactgagctgcgccgccagcggcttcaccttcagcgactactacatgagctggatcagacaggcccctggcaagggactggaatgggtgtcctacatcagcagcagcggctcgaccatctactacgccgacagcgtgaagggccggttcaccatcagccgggacaacgccaagaacagcctgtacctgcagatgaacagcctgcgggccgaggacaccgccgtgtattactgtgcgagagcccatatacgggggtacttcgatctctggggccgtggcaccctggtcactgtgtcctcaggcggaggtggaagcggagggggaggatctggcggcggaggaagcggaggcgccatccagctgacccagagccccagcagcctgagcgccagcgtgggcgatagagtgaccatcacctgtcgcgccagccagggcatcagcagcgctctggcctggtatcagcagaagcccggcaaggcccccaagctgctgatctacgacgccagctccctggaaagcggcgtgcccagcagattcagcggcagcggctccggcaccgacttcaccctgaccatcagcagcctgcagcccgaggacttcgccacctactactgccagcagtttaatagttaccctctcactttcggcggcggaacaaaggtggagatcaag

SEQ ID NO: 418 - DNA, 735 bp, Artificial Sequence
  MSLN scFv domain
gaagtgcagctgctggaaagcggcggaggcctggtgcagcctggcggcagcctgagactgtcttgcgccgccagcggcttcaccttcagcagctacgccatgagctgggtccgccaggcccctggcaagggactcgaatgggtgtccgccatcagcggcagcggcggcagcacctactacgccgacagcgtgaagggccggttcaccatcagccgggacaacagcaagaacaccctgtacctgcagatgaacagcctgcgggccgaggacaccgccgtatattactgtgcgacgtggatggggggcgggggacgatggtacttcgatctctggggccgtggcaccctggtcactgtgtcctcaggcggaggtggaagcggagggggaggatctggcggcggaggaagcggaggcgccatccagctgacccagagccccagcagcctgagcgccagcgtgggcgacagagtgaccatcacctgtcgggccagccagggcatcagcagcgctctggcctggtatcagcagaagcccggcaaggcccccaagctgctgatctacgacgcgtcctccctggaaagcggcgtgcccagcagattcagcggcagcggctccggcaccgacttcaccctgaccatcagcagcctgcagcccgaggacttcgccacctactactgccagcagtttaataattaccctctcactttcggcggcggaacaaaggtggagatcaag

SEQ ID NO: 419 - DNA, 729 bp, Artificial Sequence
  MSLN scFv domain
gaagtgcagctgctggaaagcggcggaggcctggtgcagcctggcggcagcctgagactgtcttgcgccgccagcggcttcaccttcagcagctacgccatgagctgggtccgccaggcccctggcaagggactcgaatgggtgtccgccatcagcggcagcggcggcagcacctactacgccgacagcgtgaagggccggttcaccatcagccgggacaacagcaagaacaccctgtacctgcagatgaacagcctgcgggccgaggacaccgccgtatattactgtgcgagaactagtcgtacaacctggtacttcgatctctggggccgtggcaccctggtcactgtgtcctcaggcggaggtggaagcggagggggaggatctggcggcggaggaagcggaggcgccatccagctgacccagagccccagcagcctgagcgccagcgtgggcgacagagtgaccatcacctgtcgggccagccagggcatcagcagcgctctggcctggtatcagcagaagcccggcaaggcccccaagctgctgatctacgacgcgtcctccctggaaagcggcgtgcccagcagattcagcggcagcggctccggcaccgacttcaccctgaccatcagcagcctgcagcccgaggacttcgccacctactactgccagcagtttaataattaccctctcactttcggcggcggaacaaaggtggagatcaag

SEQ ID NO: 420 - DNA, 735 bp, Artificial Sequence
  MSLN scFv domain
gaagtgcagctgctggaaagcggcggaggcctggtgcagcctggcggcagcctgagactgtcttgcgccgccagcggcttcaccttcagcagctacgccatgagctgggtccgccaggcccctggcaagggactcgaatgggtgtccgccatcagcggcagcggcggcagcacctactacgccgacagcgtgaagggccggttcaccatcagccgggacaacagcaagaacaccctgtacctgcagatgaacagcctgcgggccgaggacaccgccgtatattactgtgcgaaatggatggggggcgggggacgattatacttcgatctctggggccgtggcaccctggtcactgtgtcctcaggcggaggtggaagcggagggggaggatctggcggcggaggaagcggaggcgccatccagctgacccagagccccagcagcctgagcgccagcgtgggcgacagagtgaccatcacctgtcgggccagccagggcatcagcagcgctctggcctggtatcagcagaagcccggcaaggcccccaagctgctgatctacgacgcgtcctccctggaaagcggcgtgcccagcagattcagcggcagcggctccggcaccgacttcaccctgaccatcagcagcctgcagcccgaggacttcgccacctactactgccagcagtttaataattaccctctcactttcggcggcggaacaaaggtggagatcaag

SEQ ID NO: 421 - DNA, 732 bp, Artificial Sequence
  MSLN scFv domain
gaagtgcagctgctggaaagcggcggaggcctggtgcagcctggcggcagcctgagactgtcttgcgccgccagcggcttcaccttcagcagctacgccatgagctgggtccgccaggcccctggcaagggactcgaatgggtgtccgccatcagcggcagcggcggcagcacctactacgccgacagcgtgaagggccggttcaccatcagccgggacaacagcaagaacaccctgtacctgcagatgaacagcctgcgggccgaggacaccgccgtatattactgtgcgaaatggggggggcggttgtactggtacttcgatctctggggccgtggcaccctggtcactgtgtcctcaggcggaggtggaagcggagggggaggatctggcggcggaggaagcggaggcgccatccagctgacccagagccccagcagcctgagcgccagcgtgggcgacagagtgaccatcacctgtcgggccagccagggcatcagcagcgctctggcctggtatcagcagaagcccggcaaggcccccaagctgctgatctacgacgcgtcctccctggaaagcggcgtgcccagcagattcagcggcagcggctccggcaccgacttcaccctgaccatcagcagcctgcagcccgaggacttcgccacctactactgccagcagtttaataattaccctctcactttcggcggcggaacaaaggtggagatcaag

SEQ ID NO: 422 - DNA, 729 bp, Artificial Sequence
  MSLN scFv domain
gaagtgcagctgctggaaagcggcggaggcctggtgcagcctggcggcagcctgagactgtcttgcgccgccagcggcttcaccttcagcagctacgccatgagctgggtccgccaggcccctggcaagggactcgaatgggtgtccgccatcagcggcagcggcggcagcacctactacgccgacagcgtgaagggccggttcaccatcagccgggacaacagcaagaacaccctgtacctgcagatgaacagcctgcgggccgaggacaccgccgtatattactgtgcgaaagttattcggcaactctggtacttcgatctctggggccgtggcaccctggtcactgtgtcctcaggcggaggtggaagcggagggggaggatctggcggcggaggaagcggaggcgccatccagctgacccagagccccagcagcctgagcgccagcgtgggcgacagagtgaccatcacctgtcgggccagccagggcatcagcagcgctctggcctggtatcagcagaagcccggcaaggcccccaagctgctgatctacgacgcgtcctccctggaaagcggcgtgcccagcagattcagcggcagcggctccggcaccgacttcaccctgaccatcagcagcctgcagcccgaggacttcgccacctactactgccagcagtttaataattaccctctcactttcggcggcggaacaaaggtggagatcaag

SEQ ID NO: 423 - DNA, 729 bp, Artificial Sequence
  MSLN scFv domain
gaagtgcagctgctggaaagcggcggaggcctggtgcagcctggcggcagcctgagactgtcttgcgccgccagcggcttcaccttcagcagctacgccatgagctgggtccgccaggcccctggcaagggactcgaatgggtgtccgccatcagcggcagcggcggcagcacctactacgccgacagcgtgaagggccggttcaccatcagccgggacaacagcaagaacaccctgtacctgcagatgaacagcctgcgggccgaggacaccgccgtatattactgtgcgaaagttttcgccaactcctggtacttcgatctctggggccgtggcaccctggtcactgtgtcctcaggcggaggtggaagcggagggggaggatctggcggcggaggaagcggaggcgccatccagctgacccagagccccagcagcctgagcgccagcgtgggcgacagagtgaccatcacctgtcgggccagccagggcatcagcagcgctctggcctggtatcagcagaagcccggcaaggcccccaagctgctgatctacgacgcgtcctccctggaaagcggcgtgcccagcagattcagcggcagcggctccggcaccgacttcaccctgaccatcagcagcctgcagcccgaggacttcgccacctactactgccagcagtttaataattaccctctcactttcggcggcggaacaaaggtggagatcaag

SEQ ID NO: 424 - DNA, 729 bp, Artificial Sequence
  MSLN scFv domain
gaagtgcagctgctggaaagcggcggaggcctggtgcagcctggcggcagcctgagactgtcttgcgccgccagcggcttcaccttcagcagctacgccatgagctgggtccgccaggcccctggcaagggactcgaatgggtgtccgccatcagcggcagcggcggcagcacctactacgccgacagcgtgaagggccggttcaccatcagccgggacaacagcaagaacaccctgtacctgcagatgaacagcctgcgggccgaggacaccgccgtatattactgtgcgaaagtagataggactacctggtacttcgatctctggggccgtggcaccctggtcactgtgtcctcaggcggaggtggaagcggagggggaggatctggcggcggaggaagcggaggcgccatccagctgacccagagccccagcagcctgagcgccagcgtgggcgacagagtgaccatcacctgtcgggccagccagggcatcagcagcgctctggcctggtatcagcagaagcccggcaaggcccccaagctgctgatctacgacgcgtcctccctggaaagcggcgtgcccagcagattcagcggcagcggctccggcaccgacttcaccctgaccatcagcagcctgcagcccgaggacttcgccacctactactgccagcagtttaataattaccctctcactttcggcggcggaacaaaggtggagatcaag

SEQ ID NO: 425 - DNA, 738 bp, Artificial Sequence
  MSLN scFv domain
gaagtgcagctgctggaaagcggcggaggcctggtgcagcctggcggcagcctgagactgtcttgcgccgccagcggcttcaccttcagcagctacgccatgagctgggtccgccaggcccctggcaagggactcgaatgggtgtccgccatcagcggcagcggcggcagcacctactacgccgacagcgtgaagggccggttcaccatcagccgggacaacagcaagaacaccctgtacctgcagatgaacagcctgcgggccgaggacaccgccgtatattactgtgcgaaacgatggggtaaggatggtccttactggtacttcgatctctggggccgtggcaccctggtcactgtgtcctcaggcggaggtggaagcggagggggaggatctggcggcggaggaagcggaggcgccatccagctgacccagagccccagcagcctgagcgccagcgtgggcgacagagtgaccatcacctgtcgggccagccagggcatcagcagcgctctggcctggtatcagcagaagcccggcaaggcccccaagctgctgatctacgacgcgtcctccctggaaagcggcgtgcccagcagattcagcggcagcggctccggcaccgacttcaccctgaccatcagcagcctgcagcccgaggacttcgccacctactactgccagcagtttaataattaccctctcactttcggcggcggaacaaaggtggagatcaag

SEQ ID NO: 426 - DNA, 738 bp, Artificial Sequence
  MSLN scFv domain
gaagtgcagctgctggaaagcggcggaggcctggtgcagcctggcggcagcctgagactgtcttgcgccgccagcggcttcaccttcagcagctacgccatgagctgggtccgccaggcccctggcaagggactcgaatgggtgtccgccatcagcggcagcggcggcagcacctactacgccgacagcgtgaagggccggttcaccatcagccgggacaacagcaagaacaccctgtacctgcagatgaacagcctgcgggccgaggacaccgccgtatattactgtgcgaaaagaagagacagttatggtccttactggtacttcgatctctggggccgtggcaccctggtcactgtgtcctcaggcggaggtggaagcggagggggaggatctggcggcggaggaagcggaggcgccatccagctgacccagagccccagcagcctgagcgccagcgtgggcgacagagtgaccatcacctgtcgggccagccagggcatcagcagcgctctggcctggtatcagcagaagcccggcaaggcccccaagctgctgatctacgacgcgtcctccctggaaagcggcgtgcccagcagattcagcggcagcggctccggcaccgacttcaccctgaccatcagcagcctgcagcccgaggacttcgccacctactactgccagcagtttaataattaccctctcactttcggcggcggaacaaaggtggagatcaag

SEQ ID NO: 427 - DNA, 735 bp, Artificial Sequence
  MSLN scFv domain
gaagtgcagctgctggaaagcggcggaggcctggtgcagcctggcggcagcctgagactgtcttgcgccgccagcggcttcaccttcagcagctacgccatgagctgggtccgccaggcccctggcaagggactcgaatgggtgtccgccatcagcggcagcggcggcagcacctactacgccgacagcgtgaagggccggttcaccatcagccgggacaacagcaagaacaccctgtacctgcagatgaacagcctgcgggccgaggacaccgccgtatattactgtgcgaagaatcgtcccccgcccgggtactggtacttcgatctctggggccgtggcaccctggtcactgtgtcctcaggcggaggtggaagcggagggggaggatctggcggcggaggaagcggaggcgccatccagctgacccagagccccagcagcctgagcgccagcgtgggcgacagagtgaccatcacctgtcgggccagccagggcatcagcagcgctctggcctggtatcagcagaagcccggcaaggcccccaagctgctgatctacgacgcgtcctccctggaaagcggcgtgcccagcagattcagcggcagcggctccggcaccgacttcaccctgaccatcagcagcctgcagcccgaggacttcgccacctactactgccagcagtttaataattaccctctcactttcggcggcggaacaaaggtggagatcaag

SEQ ID NO: 428 - DNA, 729 bp, Artificial Sequence
  MSLN scFv domain
gaagtgcagctgctggaaagcggcggaggcctggtgcagcctggcggcagcctgagactgtcttgcgccgccagcggcttcaccttcagcagctacgccatgagctgggtccgccaggcccctggcaagggactcgaatgggtgtccgccatcagcggcagcggcggcagcacctactacgccgacagcgtgaagggccggttcaccatcagccgggacaacagcaagaacaccctgtacctgcagatgaacagcctgcgggccgaggacaccgccgtatattactgtgcgaagggaagacgatttagctggtacttcgatctctggggccgtggcaccctggtcactgtgtcctcaggcggaggtggaagcggagggggaggatctggcggcggaggaagcggaggcgccatccagctgacccagagccccagcagcctgagcgccagcgtgggcgacagagtgaccatcacctgtcgggccagccagggcatcagcagcgctctggcctggtatcagcagaagcccggcaaggcccccaagctgctgatctacgacgcgtcctccctggaaagcggcgtgcccagcagattcagcggcagcggctccggcaccgacttcaccctgaccatcagcagcctgcagcccgaggacttcgccacctactactgccagcagtttaataattaccctctcactttcggcggcggaacaaaggtggagatcaag

SEQ ID NO: 429 - protein, 5 aa, Artificial Sequence
  MSLN scFv domain HC CDR1
NAWMS

SEQ ID NO: 430 - protein, 5 aa, Artificial Sequence
  MSLN scFv domain HC CDR1
SYAMH

SEQ ID NO: 431 - protein, 7 aa, Artificial Sequence
  MSLN scFv domain HC CDR1
SGGYSWS

SEQ ID NO: 432 - protein, 7 aa, Artificial Sequence
  MSLN scFv domain HC CDR1
SGGYYWS

SEQ ID NO: 433 - protein, 7 aa, Artificial Sequence
  MSLN scFv domain HC CDR1
SSSYYWG

SEQ ID NO: 434 - protein, 5 aa, Artificial Sequence
  MSLN scFv domain HC CDR1
SYSMN

SEQ ID NO: 435 - protein, 5 aa, Artificial Sequence
  MSLN scFv domain HC CDR1
SYYWS

SEQ ID NO: 436 - protein, 5 aa, Artificial Sequence
  MSLN scFv domain HC CDR1
DYGMS

SEQ ID NO: 437 - protein, 5 aa, Artificial Sequence
  MSLN scFv domain HC CDR1
SYDIN

SEQ ID NO: 438 - protein, 7 aa, Artificial Sequence
  MSLN scFv domain HC CDR1
SGDYYWS

SEQ ID NO: 439 - protein, 5 aa, Artificial Sequence
  MSLN scFv domain HC CDR1
DYYMS

SEQ ID NO: 440 - protein, 6 aa, Artificial Sequence
  MSLN scFv domain HC CDR1
SSNWWS

SEQ ID NO: 441 - protein, 5 aa, Artificial Sequence
  MSLN scFv domain HC CDR1
SYGIS

SEQ ID NO: 442 - protein, 5 aa, Artificial Sequence
  MSLN scFv domain HC CDR1
SNYMS

SEQ ID NO: 443 - protein, 5 aa, Artificial Sequence
  MSLN scFv domain HC CDR1
SYGMH

SEQ ID NO: 444 - protein, 5 aa, Artificial Sequence
  MSLN scFv domain HC CDR1
DYTMH

SEQ ID NO: 445 - protein, 5 aa, Artificial Sequence
  MSLN scFv domain HC CDR1
SYAMN

SEQ ID NO: 446 - protein, 7 aa, Artificial Sequence
  MSLN scFv domain HC CDR1
SGSYYWS

SEQ ID NO: 447 - protein, 5 aa, Artificial Sequence
  MSLN scFv domain HC CDR1
SYAMS

SEQ ID NO: 448 - protein, 5 aa, Artificial Sequence
  MSLN scFv domain HC CDR1
GYTMN

SEQ ID NO: 449 - protein, 5 aa, Artificial Sequence
  MSLN scFv domain HC CDR1
SYWMH

SEQ ID NO: 450 - protein, 19 aa, Artificial Sequence
  MSLN scFv domain HC CDR2
RIKSKTDGGTTDYAAPVKG

SEQ ID NO: 451 - protein, 17 aa, Artificial Sequence
  MSLN scFv domain HC CDR2
AISSNGGSTYYANSVKG

SEQ ID NO: 452 - protein, 16 aa, Artificial Sequence
  MSLN scFv domain HC CDR2
YIYHSGSTYYNPSLKS

SEQ ID NO: 453 - protein, 17 aa, Artificial Sequence
  MSLN scFv domain HC CDR2
RINSDGSSTSYADSVKG

SEQ ID NO: 454 - protein, 16 aa, Artificial Sequence
  MSLN scFv domain HC CDR2
YIYYSGSTYYNPSLKS

SEQ ID NO: 455 - protein, 16 aa, Artificial Sequence
  MSLN scFv domain HC CDR2
SIYYSGSTYYNPSLKS

SEQ ID NO: 456 - protein, 17 aa, Artificial Sequence
  MSLN scFv domain HC CDR2
YISSSSSTIYYADSVKG

SEQ ID NO: 457 - protein, 17 aa, Artificial Sequence
  MSLN scFv domain HC CDR2
SISSSSSYIYYADSVKG

SEQ ID NO: 458 - protein, 17 aa, Artificial Sequence
  MSLN scFv domain HC CDR2
WINAGNGNTKYSQKFQG

SEQ ID NO: 459 - protein, 16 aa, Artificial Sequence
  MSLN scFv domain HC CDR2
YIYYSGSTNYNPSLKS

SEQ ID NO: 460 - protein, 17 aa, Artificial Sequence
  MSLN scFv domain HC CDR2
GINWNGGSTGYADSVKG

SEQ ID NO: 461 - protein, 17 aa, Artificial Sequence
  MSLN scFv domain HC CDR2
WMNPNSGNTGYAQKFQG

SEQ ID NO: 462 - protein, 17 aa, Artificial Sequence
  MSLN scFv domain HC CDR2
YISSSGSTIYYADSVKG

SEQ ID NO: 463 - protein, 16 aa, Artificial Sequence
  MSLN scFv domain HC CDR2
EIYHSGSTNYNPSLKS

SEQ ID NO: 464 - protein, 17 aa, Artificial Sequence
  MSLN scFv domain HC CDR2
WISAYNGNTNYAQKLQG

SEQ ID NO: 465 - protein, 16 aa, Artificial Sequence
  MSLN scFv domain HC CDR2
VIYSGGSTYYADSVKG

SEQ ID NO: 466 - protein, 17 aa, Artificial Sequence
  MSLN scFv domain HC CDR2
VIWYDGSNKYYADSVKG

SEQ ID NO: 467 - protein, 17 aa, Artificial Sequence
  MSLN scFv domain HC CDR2
LISWDGGSTYYADSVKG

SEQ ID NO: 468 - protein, 17 aa, Artificial Sequence
  MSLN scFv domain HC CDR2
WINTNTGNPTYAQGFTG

SEQ ID NO: 469 - protein, 17 aa, Artificial Sequence
  MSLN scFv domain HC CDR2
AISGSGGSTYYADSVKG

SEQ ID NO: 470 - protein, 17 aa, Artificial Sequence
  MSLN scFv domain HC CDR2
LITPYNGASSYNQKFRG

SEQ ID NO: 471 - protein, 10 aa, Artificial Sequence
  MSLN scFv domain HC CDR3
DLPKLRNFHI

SEQ ID NO: 472 - protein, 15 aa, Artificial Sequence
  MSLN scFv domain HC CDR3
LEYHGFRQYGLRYWH

SEQ ID NO: 473 - protein, 13 aa, Artificial Sequence
  MSLN scFv domain HC CDR3
IKFWFAGINYFFP

SEQ ID NO: 474 - protein, 10 aa, Artificial Sequence
  MSLN scFv domain HC CDR3
GFLGMGSNFI

SEQ ID NO: 475 - protein, 9 aa, Artificial Sequence
  MSLN scFv domain HC CDR3
GDRARYFDL

SEQ ID NO: 476 - protein, 14 aa, Artificial Sequence
  MSLN scFv domain HC CDR3
YPRGYHQMVDAFDI

SEQ ID NO: 477 - protein, 16 aa, Artificial Sequence
  MSLN scFv domain HC CDR3
VRFLAARTTIPEANFL

SEQ ID NO: 478 - protein, 9 aa, Artificial Sequence
  MSLN scFv domain HC CDR3
VLSRARFDY

SEQ ID NO: 479 - protein, 8 aa, Artificial Sequence
  MSLN scFv domain HC CDR3
LRGRVFDP

SEQ ID NO: 480 - protein, 13 aa, Artificial Sequence
  MSLN scFv domain HC CDR3
IKFTSFLYVHGFL

SEQ ID NO: 481 - protein, 13 aa, Artificial Sequence
  MSLN scFv domain HC CDR3
GQRWLYLGGIRRH

SEQ ID NO: 482 - protein, 12 aa, Artificial Sequence
  MSLN scFv domain HC CDR3
EWIPSRPYYFDY

SEQ ID NO: 483 - protein, 10 aa, Artificial Sequence
  MSLN scFv domain HC CDR3
ESTGTGAFDI

SEQ ID NO: 484 - protein, 13 aa, Artificial Sequence
  MSLN scFv domain HC CDR3
ERYRRVLHWYFDL

SEQ ID NO: 485 - protein, 7 aa, Artificial Sequence
  MSLN scFv domain HC CDR3
EPDAFDI

SEQ ID NO: 486 - protein, 12 aa, Artificial Sequence
  MSLN scFv domain HC CDR3
EHMGTIPYYFDY

SEQ ID NO: 487 - protein, 10 aa, Artificial Sequence
  MSLN scFv domain HC CDR3
EEFGYGDVLY

SEQ ID NO: 488 - protein, 10 aa, Artificial Sequence
  MSLN scFv domain HC CDR3
EDVVKGAFDI

SEQ ID NO: 489 - protein, 12 aa, Artificial Sequence
  MSLN scFv domain HC CDR3
EDFSHKLGYFQH

SEQ ID NO: 490 - protein, 5 aa, Artificial Sequence
  MSLN scFv domain HC CDR3
DYDYV

SEQ ID NO: 491 - protein, 10 aa, Artificial Sequence
  MSLN scFv domain HC CDR3
DRRDWDWFDP

SEQ ID NO: 492 - protein, 10 aa, Artificial Sequence
  MSLN scFv domain HC CDR3
DQQALKYRVD

SEQ ID NO: 493 - protein, 9 aa, Artificial Sequence
  MSLN scFv domain HC CDR3
DLTLGCFDY

SEQ ID NO: 494 - protein, 10 aa, Artificial Sequence
  MSLN scFv domain HC CDR3
DGSNSWYFDL

SEQ ID NO: 495 - protein, 9 aa, Artificial Sequence
  MSLN scFv domain HC CDR3
AFLFLSFSV

SEQ ID NO: 496 - protein, 12 aa, Artificial Sequence
  MSLN scFv domain HC CDR3
GIFYSSKEDFDY

SEQ ID NO: 497 - protein, 15 aa, Artificial Sequence
  MSLN scFv domain HC CDR3
DIWIFYSSNPKPTVY

SEQ ID NO: 498 - protein, 13 aa, Artificial Sequence
  MSLN scFv domain HC CDR3
KDQTLTYGNWFDP

SEQ ID NO: 499 - protein, 8 aa, Artificial Sequence
  MSLN scFv domain HC CDR3
DHYERGLY

SEQ ID NO: 500 - protein, 9 aa, Artificial Sequence
  MSLN scFv domain HC CDR3
YMYNWYFDL

SEQ ID NO: 501 - protein, 8 aa, Artificial Sequence
  MSLN scFv domain HC CDR3
DRRPAFDI

SEQ ID NO: 502 - protein, 10 aa, Artificial Sequence
  MSLN scFv domain HC CDR3
HLKRRPYFDY

SEQ ID NO: 503 - protein, 9 aa, Artificial Sequence
  MSLN scFv domain HC CDR3
VHKKPIFDY

SEQ ID NO: 504 - protein, 9 aa, Artificial Sequence
  MSLN scFv domain HC CDR3
TSRRCTFQH

SEQ ID NO: 505 - protein, 9 aa, Artificial Sequence
  MSLN scFv domain HC CDR3
TSPRPLFQH

SEQ ID NO: 506 - protein, 11 aa, Artificial Sequence
  MSLN scFv domain HC CDR3
PYQVRGVYFDY

SEQ ID NO: 507 - protein, 11 aa, Artificial Sequence
  MSLN scFv domain HC CDR3
PYKKRRTVFDY

SEQ ID NO: 508 - protein, 10 aa, Artificial Sequence
  MSLN scFv domain HC CDR3
LQRGLALFQH

SEQ ID NO: 509 - protein, 9 aa, Artificial Sequence
  MSLN scFv domain HC CDR3
ILSVPYFDL

SEQ ID NO: 510 - protein, 14 aa, Artificial Sequence
  MSLN scFv domain HC CDR3
GWIRVPLRLPLFQH

SEQ ID NO: 511 - protein, 9 aa, Artificial Sequence
  MSLN scFv domain HC CDR3
VTIFAIFDI

SEQ ID NO: 512 - protein, 10 aa, Artificial Sequence
  MSLN scFv domain HC CDR3
VGRGFVHFDL

SEQ ID NO: 513 - protein, 11 aa, Artificial Sequence
  MSLN scFv domain HC CDR3
TSRGLCVLFDY

SEQ ID NO: 514 - protein, 11 aa, Artificial Sequence
  MSLN scFv domain HC CDR3
SGPSSYWYFDL

SEQ ID NO: 515 - protein, 11 aa, Artificial Sequence
  MSLN scFv domain HC CDR3
NIYMGGIWFDP

SEQ ID NO: 516 - protein, 10 aa, Artificial Sequence
  MSLN scFv domain HC CDR3
LTVRTGAFDI

SEQ ID NO: 517 - protein, 10 aa, Artificial Sequence
  MSLN scFv domain HC CDR3
LRTAHLDFDL

SEQ ID NO: 518 - protein, 10 aa, Artificial Sequence
  MSLN scFv domain HC CDR3
DLIFPVVFDY

SEQ ID NO: 519 - protein, 13 aa, Artificial Sequence
  MSLN scFv domain HC CDR3
DGYRKYGYVFFDI

SEQ ID NO: 520 - protein, 13 aa, Artificial Sequence
  MSLN scFv domain HC CDR3
DGRYRRFWHAFDI

SEQ ID NO: 521 - protein, 9 aa, Artificial Sequence
  MSLN scFv domain HC CDR3
AHIRGYFDL

SEQ ID NO: 522 - protein, 12 aa, Artificial Sequence
  MSLN scFv domain HC CDR3
WMGGGGRWYFDL

SEQ ID NO: 523 - protein, 10 aa, Artificial Sequence
  MSLN scFv domain HC CDR3
TSRTTWYFDL

SEQ ID NO: 524 - protein, 12 aa, Artificial Sequence
  MSLN scFv domain HC CDR3
WMGGGGRLYFDL

SEQ ID NO: 525 - protein, 11 aa, Artificial Sequence
  MSLN scFv domain HC CDR3
WGGRLYWYFDL

SEQ ID NO: 526 - protein, 10 aa, Artificial Sequence
  MSLN scFv domain HC CDR3
VIRQLWYFDL

SEQ ID NO: 527 - protein, 10 aa, Artificial Sequence
  MSLN scFv domain HC CDR3
VFANSWYFDL

SEQ ID NO: 528 - protein, 10 aa, Artificial Sequence
  MSLN scFv domain HC CDR3
VDRTTWYFDL

SEQ ID NO: 529 - protein, 13 aa, Artificial Sequence
  MSLN scFv domain HC CDR3
RWGKDGPYWYFDL

SEQ ID NO: 530 - protein, 13 aa, Artificial Sequence
  MSLN scFv domain HC CDR3
RRDSYGPYWYFDL

SEQ ID NO: 531 - protein, 12 aa, Artificial Sequence
  MSLN scFv domain HC CDR3
NRPPPGYWYFDL

SEQ ID NO: 532 - protein, 10 aa, Artificial Sequence
  MSLN scFv domain HC CDR3
GRRFSWYFDL

SEQ ID NO: 533 - protein, 14 aa, Artificial Sequence
  MSLN scFv domain HC CDR3
CAREDVVKGAFDIW

SEQ ID NO: 534 - protein, 10 aa, Artificial Sequence
  MSLN scFv domain HC CDR3
GGYDGRGFDY

SEQ ID NO: 535 - protein, 11 aa, Artificial Sequence
  MSLN scFv domain LC CDR1
RASQSISSYLN

SEQ ID NO: 536 - protein, 11 aa, Artificial Sequence
  MSLN scFv domain LC CDR1
RASQGISSWLA

SEQ ID NO: 537 - protein, 11 aa, Artificial Sequence
  MSLN scFv domain LC CDR1
RASQGISSALA

SEQ ID NO: 538 - protein, 10 aa, Artificial Sequence
  MSLN scFv domain LC CDR1
SASSSVSYMH

SEQ ID NO: 539 - protein, 7 aa, Artificial Sequence
  MSLN scFv domain LC CDR2
AASSLQS

SEQ ID NO: 540 - protein, 7 aa, Artificial Sequence
  MSLN scFv domain LC CDR2
DASSLES

SEQ ID NO: 541 - protein, 7 aa, Artificial Sequence
  MSLN scFv domain LC CDR2
DTSKLAS

SEQ ID NO: 542 - protein, 9 aa, Artificial Sequence
  MSLN scFv domain LC CDR3
QQSYSTPLT

SEQ ID NO: 543 - protein, 9 aa, Artificial Sequence
  MSLN scFv domain LC CDR3
QQANSFPLT

SEQ ID NO: 544 - protein, 9 aa, Artificial Sequence
  MSLN scFv domain LC CDR3
QQFNSYPLT

SEQ ID NO: 545 - protein, 9 aa, Artificial Sequence
  MSLN scFv domain LC CDR3
QQWSGYPLT

SEQ ID NO: 546 - protein, 4 aa, Unknown
  immunoreceptor tyrosine-based activation motif
  SITE (2)..(3): Xaa is any amino acid
  SITE (4)..(4): Xaa is Leu or Ile
YXXX

SEQ ID NO: 547 - protein, 6 aa, Unknown
  immunoreceptor tyrosine-based activation motif
  SITE (1)..(1): Xaa is Ser, Ile, Val or Leu
  SITE (2)..(2): Xaa is any amino acid
  SITE (4)..(5): Xaa is any amino acid
  SITE (6)..(6): Xaa is Ile, Val or Leu
XXYXXX

SEQ ID NO: 548 - DNA, 741 bp, Artificial Sequence
  HLA scFv binding domain
gatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagtagagtggaggctgaggatctgggagtttattactgctttcaaggttcacatgttcctcggacgtccggtggaggcaccaagctggaaatcaaaggcggaggtggaagcggagggggaggatctggcggcggaggaagcggaggccaggtccagctgcagcagtctggacctgagctggtgaagcctggggcttcagtgaggatatcctgcaaggcttctggctacaccttcacaagttaccatatacattgggtgaagcagaggcctggacagggacttgagtggattggatggatttatcctggaaatgttaatactgagtacaatgagaagttcaagggcaaggccacactgactgcagacaaatcgtccagcacagcctacatgcacctcagcagcctgacctctgaggactctgcggtctatttctgtgccagagaggagattacctatgctatggactactggggtcaaggaacctcagtcaccgtgtcctca

SEQ ID NO: 549 - DNA, 741 bp, Artificial Sequence
  HLA scFv binding domain
caggtgcagctggtgcagtctggggctgaggtgaagaagcctgggtcctcagtgaaggtttcctgcaaggcttctggatacaccttcactagctatcatatacattgggtgcgccaggcccccggacaagggcttgagtggatgggatggatctaccctggcaatgttaacacagaatataatgagaagttcaagggcaaagccaccattaccgcggacaaatccacgagcacagcctacatggagctgagcagcctgagatctgaagacacggctgtgtattactgtgcgagggaggaaattacctacgctatggactactggggccagggaaccacagtcaccgtgtcctcaggcggaggtggaagcggagggggaggatctggcggcggaggaagcggaggcgagattgtattgacccagagcccaggcaccctgagcctctctccaggagagcgggccaccctcagttgtagatccagtcagagtattgtacacagtaatgggaacacctatttggaatggtatcagcagaaaccaggtcaagccccaagattgctcatctacaaagtctctaacagatttagtggtattccagacaggttcagcggttccggaagtggtactgatttcaccctcacgatctccaggctcgagccagaagatttcgccgtttattactgttttcaaggttcacatgtgccgcgcacattcggtgggggtactaaagtagaaatcaaa

SEQ ID NO: 550 - DNA, 741 bp, Artificial Sequence
  HLA scFv binding domain
caggtgcagctggtgcagtctggggctgaggtgaagaagcctgggtcctcagtgaaggtttcctgcaaggcttctggatacaccttcactagctatcatatacattgggtgcgccaggcccccggacaagggcttgagtggatgggatggatctaccctggcaatgttaacacagaatataatgagaagttcaagggcaaagccaccattaccgcggacaaatccacgagcacagcctacatggagctgagcagcctgagatctgaagacacggctgtgtattactgtgcgagggaggaaattacctacgctatggactactggggccagggaaccacagtcaccgtgtcctcaggcggaggtggaagcggagggggaggatctggcggcggaggaagcggaggcgacattgtaatgacccagaccccactcagcctgcccgtcactccaggagagccggccagcatcagttgtagatccagtcagagtattgtacacagtaatgggaacacctatttggaatggtatctgcagaaaccaggtcaatccccacaattgctcatctacaaagtctctaacagatttagtggtgtaccagacaggttcagcggttccggaagtggtactgatttcaccctcaagatctccagggtcgaggcagaagatgtcggcgtttattactgttttcaaggttcacatgtgccgcgcacattcggtgggggtactaaagtagaaatcaaa

SEQ ID NO: 551 - DNA, 741 bp, Artificial Sequence
  HLA scFv binding domain
gaggtgcagctggtggagtctgggggtgggctggtgaagcctgggggctcactgaggctttcctgcgcggcttctggatacaccttcactagctatcatatacattgggtgcgccaggcccccggaaaagggcttgagtgggtgggatggatctaccctggcaatgttaacacagaatataatgagaagttcaagggcagattcaccattagcagggacgattccaagaacacactctacctgcagatgaacagcctgaaaactgaagacacggctgtgtattactgtgcgagggaggaaattacctacgctatggactactggggccagggaaccacagtcaccgtgtcctcaggcggaggtggaagcggagggggaggatctggcggcggaggaagcggaggcgacattcaaatgacccagagcccatccagcctgagcgcatctgtaggtgaccgggtcaccatcacttgtagatccagtcagagtattgtacacagtaatgggaacacctatttggaatggtatcagcagaaaccaggtaaagccccaaaattgctcatctacaaagtctctaacagatttagtggtgtaccaagcaggttcagcggttccggaagtggtactgatttcaccctcacgatctcctctctccagccagaagatttcgccacttattactgttttcaaggttcacatgtgccgcgcacattcggtgggggtactaaagtagaaatcaaa

SEQ ID NO: 552 - DNA, 741 bp, Artificial Sequence
  HLA scFv binding domain
caggtgcagctggtgcagtctggggctgaggtgaagaagcctgggtcctcagtgaaggtttcctgcaaggcttctggatacaccttcactagctatcatatacattgggtgcgccaggcccccggacaagggcttgagtggatcggatggatctaccctggcaatgttaacacagaatataatgagaagttcaagggcaaagccaccattaccgcggacgaatccacgaacacagcctacatggagctgagcagcctgagatctgaagacacggctgtgtattactgtgcgagggaggaaattacctacgctatggactactggggccagggaaccctggtcaccgtgtcctcaggcggaggtggaagcggagggggaggatctggcggcggaggaagcggaggcgacattcaaatgacccagagcccatccaccctgagcgcatctgtaggtgaccgggtcaccatcacttgtagatccagtcagagtattgtacacagtaatgggaacacctatttggaatggtatcagcagaaaccaggtaaagccccaaaattgctcatctacaaagtctctaacagatttagtggtgtaccagccaggttcagcggttccggaagtggtactgaattcaccctcacgatctcctctctccagccagatgatttcgccacttattactgttttcaaggttcacatgtgccgcgcacattcggtcagggtactaaagtagaagtcaaa

SEQ ID NO: 553 - DNA, 741 bp, Artificial Sequence
  HLA scFv binding domain
caggtgcagctggtgcagtctggggctgaggtgaagaagcctgggtcctcagtgaaggtttcctgcaaggcttctggatacaccttcactagctatcatatgcattgggtgcgccaggcccccggacaagggcttgagtggatcggatacatctaccctggcaatgttaacacagaatataatgagaagttcaagggcaaagccacccttaccgcggacaaatccacgaacacagcctacatggagctgagcagcctgagatctgaagacacggctgtgtatttctgtgcgagggaggaaattacctacgctatggactactggggccagggaaccctggtcaccgtgtcctcaggcggaggtggaagcggagggggaggatctggcggcggaggaagcggaggcgacgttcaaatgacccagagcccatccaccctgagcgcatctgtaggtgaccgggtcaccatcacttgtagctccagtcagagtattgtacacagtaatgggaacacctatatggaatggtatcagcagaaaccaggtaaagccccaaaattgctcatctacaaagtctctaacagatttagtggtgtaccagacaggttcagcggttccggaagtggtactgaattcaccctcacgatctcctctctccagccagatgatttcgccacttattactgtcatcaaggttcacatgtgccgcgcacattcggtcagggtactaaagtagaagtcaaa

SEQ ID NO: 554 - DNA, 741 bp, Artificial Sequence
  HLA scFv binding domain
caggtgcagctgcagcagtctgggcctgagctggtgaagcctggggcctcagtgaagatgtcctgcaaggcttctggatacaccttcactagctatcatatccagtgggtgaagcagaggcctggacaagggcttgagtggatcggatggatctaccctggcgatggtagtacacagtataatgagaagttcaagggcaaaaccacccttaccgcggacaaatcctccagcacagcctacatgttgctgagcagcctgacctctgaagactctgctatctatttctgtgcgagggaggggacctactacgctatggactactggggccagggaacctcagtcaccgtgtcctcaggcggaggtggaagcggagggggaggatctggcggcggaggaagcggaggcgatgttttgatgacccagactccactctccctgcctgtctctcttggagaccaagtctccatctcttgtagatccagtcagagtattgtacacagtaatgggaacacctatttagaatggtatctgcagaaaccaggtcagtctccaaagttgctcatctacaaagtctctaacagatttagtggtgtaccagacaggttcagcggttccggaagtggtactgatttcaccctcaagatctcgagagtggaggctgaggatctgggagtttattactgttttcaaggttcacatgtgccgcgcacattcggtggaggtactaaactggaaatcaaa

SEQ ID NO: 555 - DNA, 741 bp, Artificial Sequence
  HLA scFv binding domain
cagctgcagctgcaggagtctgggcccgggctggtgaagccttcggaaacgctgagcctcacctgcacggtttctggatacaccttcaccagctatcatatccagtggatccgacagccccctggaaaagggcttgagtggatcggatggatctaccctggcgatggttcaacacagtacaatgagaagttcaagggcagagccacgattagcgtggacacatccaagaaccaattctccctgaacctggacagcgtgagtgctgcggacacggccatttattactgtgcgagagagggaacttactacgctatggactactggggcaaagggagcacggtcaccgtgtcctcaggcggaggtggaagcggagggggaggatctggcggcggaggaagcggaggcgacatccagatgacccagagcccaagctccctgagtgcgtccgtgggcgaccgcgtgaccatcacttgcagatcctctcagtccatcgtgcactccaacggcaacacgtacctcgagtggtaccagcagaagcccgggaaggccccgaaactgctcatctacaaggtgagcaaccggttctccggcgtccccagccgcttctcagggtccggctcggggacggatttcaccttcacgattagcagcttgcagcccgaagacatcgccacgtactactgctttcagggaagtcacgtgccgcgtaccttcgggccgggcacgaaagtggatattaag

SEQ ID NO: 556 - DNA, 741 bp, Artificial Sequence
  HLA scFv binding domain
gaggtgcagctggtgcagtctggggccgagctgaagaagcctgggtcctcggtgaaggtgtcctgcaaggcttctggatacaccttcaccagctatcatatccagtgggtaaaacaggcccctggacaagggcttgagtggatcggatggatctaccctggcgatggttcaacacagtacaatgagaagttcaagggcaaagccacgcttaccgtggacaaatccacgaacacagcctacatggagctgagcagcctgagatctgaggacacggccgtatattactgtgcgagagagggaacttactacgctatggactactggggccaagggaccctggtcaccgtgtcctcaggcggaggtggaagcggagggggaggatctggcggcggaggaagcggaggcgacatccagatgacccagagcccatccaccctgagtgcgtccgtgggcgaccgcgtgaccatcacttgcagatcctctcagtccatcgtgcactccaacggcaacacgtacctcgagtggtaccagcagaagcccgggaaggccccgaaactgctcatctacaaggtgagcaaccggttctccggcgtccccagccgcttctcagggtccggctcggggacggatttcaccctcacgattagcagcttgcagcccgatgacttcgccacgtactactgctttcagggaagtcacgtgccgcgtaccttcgggcagggcacgaaagtggaagttaag

SEQ ID NO: 557 - DNA, 741 bp, Artificial Sequence
  HLA scFv binding domain
caggtgcagctggtgcagtctggggccgaggtgaagaagcctgggtcctcggtgaaggtgtcctgcaaggcttctggatacaccttcaccagctatcatatccagtgggtacgacaggcccctggacaagggcttgagtggatgggatggatctaccctggcgatggttcaacacagtacaatgagaagttcaagggcagagtcacgattaccgcggacaaatccacgagcacagcctacatggagctgagcagcctgagatctgaggacacggccgtatattactgtgcgagagagggaacttactacgctatggactactggggccaagggaccacggtcaccgtgtcctcaggcggaggtggaagcggagggggaggatctggcggcggaggaagcggaggcgagatcgtcctgacccagagcccagggaccctgagtttgtccccgggcgagcgcgcgaccctcagttgcagatcctctcagtccatcgtgcactccaacggcaacacgtacctcgagtggtaccagcagaagcccgggcaggccccgcgactgctcatctacaaggtgagcaaccggttctccggcatccccgaccgcttctcagggtccggctcggggacggatttcaccctcacgattagccgcttggagcccgaagacttcgccgtgtactactgctttcagggaagtcacgtgccgcgtaccttcggggggggcacgaaagtggaaattaag

SEQ ID NO: 558 - DNA, 741 bp, Artificial Sequence
  HLA scFv binding domain
caggtgaccctgaagcagtctggggccgaggtgaagaagcctgggtcctcggtgaaggtgtcctgcacggcttctggatacaccttcaccagctatcatgtcagctgggtacgacaggcccctggacaagggcttgagtggttgggaaggatctaccctggcgatggttcaacacagtacaatgagaagttcaagggcaaagtcacgattaccgcggacaaatccatggacacatccttcatggagctgaccagcctgacatctgaggacacggccgtatattactgtgcgagagagggaacttactacgctatggacctctggggccaagggaccctggtcaccgtgtcctcaggcggaggtggaagcggagggggaggatctggcggcggaggaagcggaggcgagatcgtcctgacccagagcccagggaccctgagtttgtccccgggcgagcgcgcgaccctcagttgcagatcctctcagtccatcgtgcactccaacggcaacacgtacctcgcgtggtaccagcagaagcccgggcaggccccgcgactgctcatctccaaggtgagcaaccggttctccggcgtccccgaccgcttctcagggtccggctcggggacggatttcaccctcacgattagccgcttggagcccgaagacttcgccgtgtactactgccaacagggaagtcacgtgccgcgtaccttcggggggggcacgaaagtggaaattaag

SEQ ID NO: 559 - DNA, 741 bp, Artificial Sequence
  HLA scFv binding domain
caggtgcagctggtgcagtctggggccgaggtgaagaagcctggggcctcggtgaaggtgtcctgcaaggcttctggatacaccttcaccagctatcatatgcactgggtacgacaggcccctggacaaaggcttgagtggatgggatggatctaccctggcgatggttcaacacagtacaatgagaagttcaagggcaaagtcacgattacccgggacacatccgcgagcacagcctacatggagctgagcagcctgagatctgaggacacggccgtatattactgtgcgagagagggaacttactacgctatggactactggggccaagggaccctggtcaccgtgtcctcaggcggaggtggaagcggagggggaggatctggcggcggaggaagcggaggcgacatcgtcatgacccagaccccactgtccctgcctgtgaccccgggcgagcccgcgagcatcagttgcagatcctctcagtccatcgtgcactccaacggcaacacgtacctcgactggtacctgcagaagcccgggcagtccccgcaactgctcatctacaaggtgagcaaccggttctccggcgtccccgaccgcttctcagggtccggctcggggacggatttcaccctcaagattagccgcgtggaggccgaagacgtcggcgtgtactactgcatgcagggaagtcacgtgccgcgtaccttcggggggggcacgaaagtggaaattaag

SEQ ID NO: 560 - protein, 244 aa, Artificial Sequence
  HLA-B*07 antigen binding domain
QVQLQESGPGLVKPSQTLSLTCTVSGYSITSGYSWHWIRQPPGKGLEWIGYIHFSGSTHYHPSLKSRVTISVDTSKNQFSLKLSSVTAADTAVYYCARGGVVSHYAMDCWGQGTTVTVSSGGGGSGGGGSGGGGSGGDIQMTQSPSSLSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 561 - protein, 244 aa, Artificial Sequence
  HLA-B*07 antigen binding domain
EVQLVESGGGLVKPGGSLRLSCAASGYSITSGYSWHWVRQAPGKGLEWVSYIHFSGSTHYHPSLKSRFTISRDNAKNSLYLQMNSLRAEDTAVYYCARGGVVSHYAMDCWGQGTTVTVSSGGGGSGGGGSGGGGSGGDIQMTQSPSSVSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 562 - protein, 244 aa, Artificial Sequence
  HLA-B*07 antigen binding domain
EVQLVESGGGLVKPGGSLRLSCAASGYSITSGYSWHWVRQAPGKGLEWVGYIHFSGSTHYHPSLKSRFTISRDDSKNTLYLQMNSLKTEDTAVYYCARGGVVSHYAMDCWGQGTTVTVSSGGGGSGGGGSGGGGSGGEIVLTQSPATLSLSPGERATLSCRASENIYSNLAWYQQKPGQAPRLLIYAATYLPDGIPARFSGSGSGTDFTLTISSLEPEDFAVYYCQHFWVTPYTFGGGTKVEIK

SEQ ID NO: 563 - protein, 244 aa, Artificial Sequence
  HLA-B*07 antigen binding domain
QVQLQQSGPGLVKPSQTLSLTCAISGYSITSGYSWHWIRQSPSRGLEWLGYIHFSGSTHYHPSLKSRITINPDTSKNQFSLQLNSVTPEDTAVYYCARGGVVSHYAMDCWGQGTTVTVSSGGGGSGGGGSGGGGSGGEIVLTQSPATLSLSPGERATLSCRASENIYSNLAWYQQKPGQAPRLLIYAATYLPDGIPARFSGSGSGTDFTLTISRLEPEDFAVYYCQHFWVTPYTFGGGTKVEIK

SEQ ID NO: 564 - protein, 244 aa, Artificial Sequence
  HLA-B*07 antigen binding domain
EVQLVESGGGLVKPGGSLRLSCAASGYSITSGYSWHWVRQAPGKGLEWVGYIHFSGSTHYHPSLKSRFTISRDDSKNTLYLQMNSLKTEDTAVYYCARGGVVSHYAMDCWGQGTTVTVSSGGGGSGGGGSGGGGSGGDIQMTQSPSSVSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 565 - protein, 244 aa, Artificial Sequence
  HLA-B*07 antigen binding domain
EVQLVESGGGLVQPGGSLRLSCAASGYSITSGYSWHWVRQAPGKGLEWVSYIHFSGSTHYHPSLKSRFTISRDNSKNTLYLQMNSLRAEDTAVYYCARGGVVSHYAMDCWGQGTTVTVSSGGGGSGGGGSGGGGSGGDIQMTQSPSSLSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 566 - protein, 244 aa, Artificial Sequence
  HLA-B*07 antigen binding domain
EVQLVESGGGLVKPGGSLRLSCAASGYSITSGYSWHWVRQAPGKGLEWVGYIHFSGSTHYHPSLKSRFTISRDDSKNTLYLQMNSLKTEDTAVYYCARGGVVSHYAMDCWGQGTTVTVSSGGGGSGGGGSGGGGSGGDIQMTQSPSSLSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 567 - protein, 244 aa, Artificial Sequence
  HLA-B*07 antigen binding domain
QVQLQQWGAGLLKPSETLSLTCAVYGYSITSGYSWHWIRQPPGKGLEWIGYIHFSGSTHYHPSLKSRVTISVDTSKNQFSLKLSSVTAADTAVYYCARGGVVSHYAMDCWGQGTTVTVSSGGGGSGGGGSGGGGSGGDIQMTQSPSSLSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 568 - protein, 244 aa, Artificial Sequence
  HLA-B*07 antigen binding domain
QVQLQESGPGLVKPSQTLSLTCTVSGYSITSGYSWHWIRQHPGKGLEWIGYIHFSGSTHYHPSLKSRVTISVDTSKNQFSLKLSSVTAADTAVYYCARGGVVSHYAMDCWGQGTTVTVSSGGGGSGGGGSGGGGSGGDIQMTQSPSSLSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 569 - protein, 244 aa, Artificial Sequence
  HLA-B*07 antigen binding domain
QVQLQQSGPGLVKPSQTLSLTCAISGYSITSGYSWHWIRQSPSRGLEWLGYIHFSGSTHYHPSLKSRITINPDTSKNQFSLQLNSVTPEDTAVYYCARGGVVSHYAMDCWGQGTTVTVSSGGGGSGGGGSGGGGSGGDIQMTQSPSSLSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 570 - protein, 240 aa, Artificial Sequence
  HLA-C*07 antigen binding domain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAVSFDWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 571 - protein, 248 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARERSISPYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 572 - protein, 247 aa, Artificial Sequence
  HLA-C*07 antigen binding domain
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARDSVIWYWFDPWGQGTLVTVSSGGGGSGGGGSGGGGSGGQSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL

SEQ ID NO: 573 - protein, 249 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREEILPRLSYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 574 - protein, 245 aa, Artificial Sequence
  HLA-C*07 antigen binding domain
QVQLVQSGSELKKPGASVKVSCKASGYTFTSYAMNWVRQAPGQGLEWMGWINTNTGNPTYAQGFTGRFVFSFDTSVSTAYLQICSLKAEDTAVYYCARGGRAHSSWYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 575 - protein, 251 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDRIKILPRLGYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 576 - protein, 246 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDTVIHYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 577 - protein, 250 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDVIVEVFLSYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 578 - protein, 246 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDIFIHYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 579 - protein, 247 aa, Artificial Sequence
  HLA-C*07 antigen binding domain
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARDGTFYSYSPYYFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 580 - protein, 251 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREWIKILPRLGYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 581 - protein, 246 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDRSLYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 582 - protein, 248 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDKILAPNYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 583 - protein, 250 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREKSWKYFYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 584 - protein, 249 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARENTSTIPYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 585 - protein, 253 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREDVDKNTSTIYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 586 - protein, 250 aa, Artificial Sequence
  HLA-C*07 antigen binding domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDGGDIVSSSAIYWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIK

SEQ ID NO: 587 - protein, 248 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDLILPPYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 588 - protein, 253 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARETWIKILPRYYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 589 - protein, 246 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDLSRYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 590 - protein, 242 aa, Artificial Sequence
  HLA-C*07 antigen binding domain
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCAREHIVLCFDYWGQGTLVTVSSGGGGSGGGGSGGGGSGGDIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIK

SEQ ID NO: 591 - protein, 249 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDKILPRPYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 592 - protein, 244 aa, Artificial Sequence
  HLA-C*07 antigen binding domain
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGSNEYFQHWGQGTLVTVSSGGGGSGGGGSGGGGSGGQSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNWVFGGGTKLTVL

SEQ ID NO: 593 - protein, 242 aa, Artificial Sequence
  HLA-C*07 antigen binding domain
QVQLVQSGSELKKPGASVKVSCKASGYTFTSYAMNWVRQAPGQGLEWMGWINTNTGNPTYAQGFTGRFVFSFDTSVSTAYLQICSLKAEDTAVYYCARGTSYWYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 594 - protein, 248 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREEIVEVFYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 595 - protein, 241 aa, Artificial Sequence
  HLA-C*07 antigen binding domain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVDDYYFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 596 - protein, 247 aa, Artificial Sequence
  HLA-C*07 antigen binding domain
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCAWSTNILLSYTKAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 597 - protein, 246 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDKTYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 598 - protein, 253 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREKYFHDKYFHDYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 599 - protein, 246 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDTSVYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 600 - protein, 248 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREKILPYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 601 - protein, 257 aa, Artificial Sequence
  HLA-C*07 antigen binding domain
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCAIQWIYIYINPRGFIFLHDAFDIWGQGTMVTVSSGGGGSGGGGSGGGGSGGQSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL

SEQ ID NO: 602 - protein, 248 aa, Artificial Sequence
  HLA-C*07 antigen binding domain
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAKEDVDFHHDAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 603 - protein, 253 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREGVDKNTSTIYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 604 - protein, 241 aa, Artificial Sequence
  HLA-C*07 antigen binding domain
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARDRRGYFDLWGRGTLVTVSSGGGGSGGGGSGGGGSGGDIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIK

SEQ ID NO: 605 - protein, 248 aa, Artificial Sequence
  HLA-C*07 antigen binding domain
EVQLVQSGAEVKKPGATVKISCKVSGYTFTDYYMHWVQQAPGKGLEWMGLVDPEDGETIYAEKFQGRVTITADTSTDTAYMELSSLRSEDTAVYYCATGIHVDIRSMEDWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 606 - protein, 246 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDIGTSYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 607 - protein, 249 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREVVEVFLYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 608 - protein, 246 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDLYYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 609 - protein, 256 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARESWKYFYPRGSIFIHYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 610 - protein, 248 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDRIVEVFYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 611 - protein, 250 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREKYFHDWLYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 612 - protein, 250 aa, Artificial Sequence
  HLA-C*07 antigen binding domain
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDLVDKNTSYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 613 - protein, 244 aa, Artificial Sequence
  HLA-C*07 antigen binding domain
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVQNEYFQHWGQGTLVTVSSGGGGSGGGGSGGGGSGGQSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNWVFGGGTKLTVL

SEQ ID NO: 614 - protein, 239 aa, Artificial Sequence
  HLA-C*07 antigen binding domain
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCATANWFDPWGQGTLVTVSSGGGGSGGGGSGGGGSGGDIQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIK

SEQ ID NO: 615 - protein, 244 aa, Artificial Sequence
  HLA-A*03 scFv
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARERVSQRGAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 616 - protein, 243 aa, Artificial Sequence
  HLA-A*03 scFv
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARGNPDKDPFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 617 - protein, 245 aa, Artificial Sequence
  HLA-A*03 scFv
QVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCARDFYCTNWYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 618 - protein, 244 aa, Artificial Sequence
  HLA-A*03 scFv
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARESSSGSYWYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 619 - protein, 250 aa, Artificial Sequence
  HLA-A*03 scFv
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARDSGYKYNLYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 620 - protein, 249 aa, Artificial Sequence
  HLA-A*03 scFv
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGGDLSHYYYYMDVWGKGTTVTVSSGGGGSGGGGSGGGGSGGQTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAQWVFGGGTKLTVL

SEQ ID NO: 621 - protein, 246 aa, Artificial Sequence
  HLA-A*03 scFv
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARENRRYNSCYYFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 622 - protein, 249 aa, Artificial Sequence
  HLA-A*03 scFv
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGGDLSHYYYYLDVWGKGTTVTVSSGGGGSGGGGSGGGGSGGQTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAQWVFGGGTKLTVL

SEQ ID NO: 623 - protein, 245 aa, Artificial Sequence
  HLA-A*03 scFv
EVQLVESGGGLVQPGGSLRLSCAASGFTVSSNYMSWVRQAPGKGLEWVSVIYSGGSTYYADSVKGRFTISRDNSKNTLYLQMNSLRAEDTAVYYCARATLLSLSYDAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 624 - protein, 248 aa, Artificial Sequence
  HLA-A*03 scFv
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGGDLSHYYYMDVWGKGTTVTVSSGGGGSGGGGSGGGGSGGQTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAQWVFGGGTKLTVL

SEQ ID NO: 625 - protein, 241 aa, Artificial Sequence
  HLA-A*03 scFv
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARERDRWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 626 - protein, 247 aa, Artificial Sequence
  HLA-A*03 scFv
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARETPPSLGAFDIWGQGTMVTVSSGGGGSGGGGSGGGGSGGQSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNWVFGGGTKLTVL

SEQ ID NO: 627 - protein, 251 aa, Artificial Sequence
  HLA-A*03 scFv
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCAREAYCLSDSYWYFDLWGRGTLVTVSSGGGGSGGGGSGGGGSGGQSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL

SEQ ID NO: 628 - protein, 248 aa, Artificial Sequence
  HLA-A*03 scFv
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARESWKYFYPRGYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 629 - protein, 248 aa, Artificial Sequence
  HLA-A*01 scFv
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGGWTAWYYYMDVWGKGTTVTVSSGGGGSGGGGSGGGGSGGQTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAQWVFGGGTKLTVL

SEQ ID NO: 630 - protein, 244 aa, Artificial Sequence
  HLA-A*01 scFv
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARAKYYYMDVWGKGTTVTVSSGGGGSGGGGSGGGGSGGQSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL

SEQ ID NO: 631 - protein, 248 aa, Artificial Sequence
  HLA-A*01 scFv
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDQVDKNTYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 632 - protein, 243 aa, Artificial Sequence
  HLA-A*01 scFv
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARACQLAEYFQHWGQGTLVTVSSGGGGSGGGGSGGGGSGGDIQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIK

SEQ ID NO: 633 - protein, 248 aa, Artificial Sequence
  HLA-A*01 scFv
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDRVDKNTSYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 634 - protein, 245 aa, Artificial Sequence
  HLA-A*01 scFv
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCARRVQLKLVHWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 635 - protein, 245 aa, Artificial Sequence
  HLA-A*01 scFv
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCATYYDYVTVFYFQHWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 636 - protein, 245 aa, Artificial Sequence
  HLA-A*01 scFv
QLQLQESGSGLVKPSQTLSLTCAVSGGSISSGGYSWSWIRQPPGKGLEWIGYIYHSGSTYYNPSLKSRVTISVDRSKNQFSLKLSSVTAADTAVYYCARESYPSFYAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 637 - protein, 249 aa, Artificial Sequence
  HLA-A*01 scFv
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHSNMWSYSLNDYYFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 638 - protein, 11 aa, Artificial Sequence
  CDR-L1
RASQSISSYLN

SEQ ID NO: 639 - protein, 14 aa, Artificial Sequence
  CDR-L1
ASSTGAVTSGYYPN

SEQ ID NO: 640 - protein, 14 aa, Artificial Sequence
  CDR-L1
TGTSSDVGGYNYVS

SEQ ID NO: 641 - protein, 13 aa, Artificial Sequence
  CDR-L1
SGSSSNIGSNTVN

SEQ ID NO: 642 - protein, 11 aa, Artificial Sequence
  CDR-L1
RASENIYSNLA

SEQ ID NO: 643 - protein, 11 aa, Artificial Sequence
  CDR-L1
RASQGISSALA

SEQ ID NO: 644 - protein, 11 aa, Artificial Sequence
  CDR-L1
RASQGISSWLA

SEQ ID NO: 645 - protein, 7 aa, Artificial Sequence
  CDR-L2
AASSLQS

SEQ ID NO: 646 - protein, 7 aa, Artificial Sequence
  CDR-L2
STSNKHS

SEQ ID NO: 647 - protein, 7 aa, Artificial Sequence
  CDR-L2
EVSKRPS

SEQ ID NO: 648 - protein, 7 aa, Artificial Sequence
  CDR-L2
SNNQRPS

SEQ ID NO: 649 - protein, 7 aa, Artificial Sequence
  CDR-L2
AATYLPD

SEQ ID NO: 650 - protein, 9 aa, Artificial Sequence
  CDR-L3
QQSYSTPLT

SEQ ID NO: 651 - protein, 10 aa, Artificial Sequence
  CDR-L3
LLYYGGAQWV

SEQ ID NO: 652 - protein, 10 aa, Artificial Sequence
  CDR-L3
SSYAGSNNWV

SEQ ID NO: 653 - protein, 11 aa, Artificial Sequence
  CDR-L3
AAWDDSLNGWV

SEQ ID NO: 654 - protein, 9 aa, Artificial Sequence
  CDR-L3
QHFWVTPYT

SEQ ID NO: 655 - protein, 9 aa, Artificial Sequence
  CDR-L3
QQYNSYPLT

SEQ ID NO: 656 - protein, 9 aa, Artificial Sequence
  CDR-L3
QQANSFPLT

SEQ ID NO: 657 - protein, 5 aa, Artificial Sequence
  CDR-H1
SYGIS

SEQ ID NO: 658 - protein, 5 aa, Artificial Sequence
  CDR-H1
SYSMN

SEQ ID NO: 659 - protein, 7 aa, Artificial Sequence
  CDR-H1
SGSYYWS

SEQ ID NO: 660 - protein, 5 aa, Artificial Sequence
  CDR-H1
SYYWS

SEQ ID NO: 661 - protein, 5 aa, Artificial Sequence
  CDR-H1
SYWIG

SEQ ID NO: 662 - protein, 5 aa, Artificial Sequence
  CDR-H1
SNYMS

SEQ ID NO: 663 - protein, 7 aa, Artificial Sequence
  CDR-H1
SSSYYWG

SEQ ID NO: 664 - protein, 7 aa, Artificial Sequence
  CDR-H1
SGGYYWS

SEQ ID NO: 665 - protein, 6 aa, Artificial Sequence
  CDR-H1
SGYSWH

SEQ ID NO: 666 - protein, 7 aa, Artificial Sequence
  CDR-H1
TSGVGVG

SEQ ID NO: 667 - protein, 5 aa, Artificial Sequence
  CDR-H1
SYWMH

SEQ ID NO: 668 - protein, 5 aa, Artificial Sequence
  CDR-H1
SYAMS

SEQ ID NO: 669 - protein, 5 aa, Artificial Sequence
  CDR-H1
SYAMN

SEQ ID NO: 670 - protein, 5 aa, Artificial Sequence
  CDR-H1
DYYMS

SEQ ID NO: 671 - protein, 7 aa, Artificial Sequence
  CDR-H1
SNSAAWN

SEQ ID NO: 672 - protein, 5 aa, Artificial Sequence
  CDR-H1
DYYMH

SEQ ID NO: 673 - protein, 6 aa, Artificial Sequence
  CDR-H1
SSNWWG

SEQ ID NO: 674 - protein, 5 aa, Artificial Sequence
  CDR-H1
SYDIN

SEQ ID NO: 675 - protein, 7 aa, Artificial Sequence
  CDR-H1
SGGYSWS

SEQ ID NO: 676 - protein, 17 aa, Artificial Sequence
  CDR-H2
WISAYNGNTNYAQKLQG

SEQ ID NO: 677 - protein, 17 aa, Artificial Sequence
  CDR-H2
YISSSSSTIYYADSVKG

SEQ ID NO: 678 - protein, 16 aa, Artificial Sequence
  CDR-H2
YIYYSGSTNYNPSLKS

SEQ ID NO: 679 - protein, 17 aa, Artificial Sequence
  CDR-H2
IIYPGDSDTRYSPSFQG

SEQ ID NO: 680 - protein, 16 aa, Artificial Sequence
  CDR-H2
VIYSGGSTYYADSVKG

SEQ ID NO: 681 - protein, 16 aa, Artificial Sequence
  CDR-H2
SIYYSGSTYYNPSLKS

SEQ ID NO: 682 - protein, 16 aa, Artificial Sequence
  CDR-H2
YIYYSGSTYYNPSLKS

SEQ ID NO: 683 - protein, 16 aa, Artificial Sequence
  CDR-H2
YIHFSGSTHYHPSLKS

SEQ ID NO: 684 - protein, 16 aa, Artificial Sequence
  CDR-H2
LIYWNDDKRYSPSLKS

SEQ ID NO: 685 - protein, 17 aa, Artificial Sequence
  CDR-H2
RINSDGSSTSYADSVKG

SEQ ID NO: 686 - protein, 17 aa, Artificial Sequence
  CDR-H2
AISGSGGSTYYADSVKG

SEQ ID NO: 687 - protein, 17 aa, Artificial Sequence
  CDR-H2
WINTNTGNPTYAQGFTG

SEQ ID NO: 688 - protein, 17 aa, Artificial Sequence
  CDR-H2
YISSSGSTIYYADSVKG

SEQ ID NO: 689 - protein, 18 aa, Artificial Sequence
  CDR-H2
RTYYRSKWYNDYAVSVKS

SEQ ID NO: 690 - protein, 17 aa, Artificial Sequence
  CDR-H2
LVDPEDGETIYAEKFQG

SEQ ID NO: 691 - protein, 17 aa, Artificial Sequence
  CDR-H2
WMNPNSGNTGYAQKFQG

SEQ ID NO: 692 - protein, 16 aa, Artificial Sequence
  CDR-H2
YIYHSGSTYYNPSLKS

SEQ ID NO: 693 - protein, 11 aa, Artificial Sequence
  CDR-H3
ERVSQRGAFDI

SEQ ID NO: 694 - protein, 10 aa, Artificial Sequence
  CDR-H3
GNPDKDPFDY

SEQ ID NO: 695 - protein, 11 aa, Artificial Sequence
  CDR-H3
DFYCTNWYFDL

SEQ ID NO: 696 - protein, 12 aa, Artificial Sequence
  CDR-H3
ESSSGSYWYFDL

SEQ ID NO: 697 - protein, 17 aa, Artificial Sequence
  CDR-H3
DSGYKYNLYYYYYYMDV

SEQ ID NO: 698 - protein, 13 aa, Artificial Sequence
  CDR-H3
GGDLSHYYYYMDV

SEQ ID NO: 699 - protein, 13 aa, Artificial Sequence
  CDR-H3
ENRRYNSCYYFDY

SEQ ID NO: 700 - protein, 13 aa, Artificial Sequence
  CDR-H3
GGDLSHYYYYLDV

SEQ ID NO: 701 - protein, 13 aa, Artificial Sequence
  CDR-H3
ATLLSLSYDAFDI

SEQ ID NO: 702 - protein, 12 aa, Artificial Sequence
  CDR-H3
GGDLSHYYYMDV

SEQ ID NO: 703 - protein, 8 aa, Artificial Sequence
  CDR-H3
ERDRWFDP

SEQ ID NO: 704 - protein, 11 aa, Artificial Sequence
  CDR-H3
ETPPSLGAFDI

SEQ ID NO: 705 - protein, 14 aa, Artificial Sequence
  CDR-H3
EAYCLSDSYWYFDL

SEQ ID NO: 706 - protein, 14 aa, Artificial Sequence
  CDR-H3
ESWKYFYPRGYMDV

SEQ ID NO: 707 - protein, 11 aa, Artificial Sequence
  CDR-H3
GGVVSHYAMDC

SEQ ID NO: 708 - protein, 7 aa, Artificial Sequence
  CDR-H3
SFDWFDP

SEQ ID NO: 709 - protein, 14 aa, Artificial Sequence
  CDR-H3
ERSISPYYYYYMDV

SEQ ID NO: 710 - protein, 10 aa, Artificial Sequence
  CDR-H3
DSVIWYWFDP

SEQ ID NO: 711 - protein, 15 aa, Artificial Sequence
  CDR-H3
EEILPRLSYYYYMDV

SEQ ID NO: 712 - protein, 12 aa, Artificial Sequence
  CDR-H3
GGRAHSSWYFDL

SEQ ID NO: 713 - protein, 17 aa, Artificial Sequence
  CDR-H3
DRIKILPRLGYYYYMDV

SEQ ID NO: 714 - protein, 12 aa, Artificial Sequence
  CDR-H3
DTVIHYYYYMDV

SEQ ID NO: 715 - protein, 16 aa, Artificial Sequence
  CDR-H3
DVIVEVFLSYYYYMDV

SEQ ID NO: 716 - protein, 12 aa, Artificial Sequence
  CDR-H3
DIFIHYYYYMDV

SEQ ID NO: 717 - protein, 14 aa, Artificial Sequence
  CDR-H3
DGTFYSYSPYYFDY

SEQ ID NO: 718 - protein, 17 aa, Artificial Sequence
  CDR-H3
EWIKILPRLGYYYYMDV

SEQ ID NO: 719 - protein, 12 aa, Artificial Sequence
  CDR-H3
DRSLYYYYYMDV

SEQ ID NO: 720 - protein, 14 aa, Artificial Sequence
  CDR-H3
DKILAPNYYYYMDV

SEQ ID NO: 721 - protein, 16 aa, Artificial Sequence
  CDR-H3
EKSWKYFYYYYYYMDV

SEQ ID NO: 722 - protein, 15 aa, Artificial Sequence
  CDR-H3
ENTSTIPYYYYYMDV

SEQ ID NO: 723 - protein, 19 aa, Artificial Sequence
  CDR-H3
EDVDKNTSTIYYYYYYMDV

SEQ ID NO: 724 - protein, 17 aa, Artificial Sequence
  CDR-H3
DGGDIVSSSAIYWYFDL

SEQ ID NO: 725 - protein, 14 aa, Artificial Sequence
  CDR-H3
DLILPPYYYYYMDV

SEQ ID NO: 726 - protein, 19 aa, Artificial Sequence
  CDR-H3
ETWIKILPRYYYYYYYMDV

SEQ ID NO: 727 - protein, 12 aa, Artificial Sequence
  CDR-H3
DLSRYYYYYMDV

SEQ ID NO: 728 - protein, 9 aa, Artificial Sequence
  CDR-H3
EHIVLCFDY

SEQ ID NO: 729 - protein, 15 aa, Artificial Sequence
  CDR-H3
DKILPRPYYYYYMDV

SEQ ID NO: 730 - protein, 8 aa, Artificial Sequence
  CDR-H3
GSNEYFQH

SEQ ID NO: 731 - protein, 9 aa, Artificial Sequence
  CDR-H3
GTSYWYFDL

SEQ ID NO: 732 - protein, 14 aa, Artificial Sequence
  CDR-H3
EEIVEVFYYYYMDV

SEQ ID NO: 733 - protein, 8 aa, Artificial Sequence
  CDR-H3
VDDYYFDY

SEQ ID NO: 734 - protein, 14 aa, Artificial Sequence
  CDR-H3
STNILLSYTKAFDI

SEQ ID NO: 735 - protein, 12 aa, Artificial Sequence
  CDR-H3
DKTYYYYYYMDV

SEQ ID NO: 736 - protein, 19 aa, Artificial Sequence
  CDR-H3
EKYFHDKYFHDYYYYYMDV

SEQ ID NO: 737 - protein, 12 aa, Artificial Sequence
  CDR-H3
DTSVYYYYYMDV

SEQ ID NO: 738 - protein, 14 aa, Artificial Sequence
  CDR-H3
EKILPYYYYYYMDV

SEQ ID NO: 739 - protein, 21 aa, Artificial Sequence
  CDR-H3
QWIYIYINPRGFIFLHDAFDI

SEQ ID NO: 740 - protein, 12 aa, Artificial Sequence
  CDR-H3
EDVDFHHDAFDI

SEQ ID NO: 741 - protein, 19 aa, Artificial Sequence
  CDR-H3
EGVDKNTSTIYYYYYYMDV

SEQ ID NO: 742 - protein, 8 aa, Artificial Sequence
  CDR-H3
DRRGYFDL

SEQ ID NO: 743 - protein, 15 aa, Artificial Sequence
  CDR-H3
GIHVDIRSMEDWFDP

SEQ ID NO: 744 - protein, 12 aa, Artificial Sequence
  CDR-H3
DIGTSYYYYMDV

SEQ ID NO: 745 - protein, 15 aa, Artificial Sequence
  CDR-H3
EVVEVFLYYYYYMDV

SEQ ID NO: 746 - protein, 12 aa, Artificial Sequence
  CDR-H3
DLYYYYYYYMDV

SEQ ID NO: 747 - protein, 22 aa, Artificial Sequence
  CDR-H3
ESWKYFYPRGSIFIHYYYYMDV

SEQ ID NO: 748 - protein, 14 aa, Artificial Sequence
  CDR-H3
DRIVEVFYYYYMDV

SEQ ID NO: 749 - protein, 16 aa, Artificial Sequence
  CDR-H3
EKYFHDWLYYYYYMDV

SEQ ID NO: 750 - protein, 16 aa, Artificial Sequence
  CDR-H3
DLVDKNTSYYYYYMDV

SEQ ID NO: 751 - protein, 8 aa, Artificial Sequence
  CDR-H3
VQNEYFQH

SEQ ID NO: 752 - protein, 6 aa, Artificial Sequence
  CDR-H3
ANWFDP

SEQ ID NO: 753 - protein, 12 aa, Artificial Sequence
  CDR-H3
GGWTAWYYYMDV

SEQ ID NO: 754 - protein, 8 aa, Artificial Sequence
  CDR-H3
AKYYYMDV

SEQ ID NO: 755 - protein, 14 aa, Artificial Sequence
  CDR-H3
DQVDKNTYYYYMDV

SEQ ID NO: 756 - protein, 10 aa, Artificial Sequence
  CDR-H3
ACQLAEYFQH

SEQ ID NO: 757 - protein, 14 aa, Artificial Sequence
  CDR-H3
DRVDKNTSYYYMDV

SEQ ID NO: 758 - protein, 12 aa, Artificial Sequence
  CDR-H3
RVQLKLVHWFDP

SEQ ID NO: 759 - protein, 12 aa, Artificial Sequence
  CDR-H3
YYDYVTVFYFQH

SEQ ID NO: 760 - protein, 11 aa, Artificial Sequence
  CDR-H3
ESYPSFYAFDI

SEQ ID NO: 761 - protein, 15 aa, Artificial Sequence
  CDR-H3
SNMWSYSLNDYYFDY

SEQ ID NO: 762 - protein, 112 aa, Artificial Sequence
  extracellular ligand binding domain VL
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPRTSGGGTKLEIK

SEQ ID NO: 763 - protein, 118 aa, Artificial Sequence
  extracellular ligand binding domain VH
QVQLQQSGPELVKPGASVRISCKASGYTFTSYHIHWVKQRPGQGLEWIGWIYPGNVNTEYNEKFKGKATLTADKSSSTAYMHLSSLTSEDSAVYFCAREEITYAMDYWGQGTSVTVSS

SEQ ID NO: 764 - protein, 18 aa, Unknown
  T2A self-cleaving peptide
EGRGSLLTCGDVEENPGP

SEQ ID NO: 765 - protein, 19 aa, Unknown
  P2A self-cleaving peptide
ATNFSLLKQAGDVEENPGP

SEQ ID NO: 766 - protein, 20 aa, Unknown
  E2A self-cleaving peptide
QCTNYALLKLAGDVESNPGP

SEQ ID NO: 767 - protein, 22 aa, Unknown
  F2A self-cleaving peptide
VKQTLNFDLLKLAGDVESNPGP

SEQ ID NO: 768 - DNA, 63 bp, Unknown
  encodes T2A self-cleaving peptide
ggatccggagagggcagaggcagcctgctgacatgtggcgacgtggaagagaaccctggcccc

SEQ ID NO: 769 - RNA, 943 nt, Homo sapiens
auuccugaagcugacagcauucgggccgagaugucucgcuccguggccuuagcugugcucgcgcuacucucucuuucuggccuggaggcuauccagcguacuccaaagauucagguuuacucacgucauccagcagagaauggaaagucaaauuuccugaauugcuaugugucuggguuucauccauccgacauugaaguugacuuacugaagaauggagagagaauugaaaaaguggagcauucagacuugucuuucagcaaggacuggucuuucuaucucuuguacuacacugaauucacccccacugaaaaagaugaguaugccugccgugugaaccaugugacuuugucacagcccaagauaguuaagugggaucgagacauguaagcagcaucauggagguuugaagaugccgcauuuggauuggaugaauuccaaauucugcuugcuugcuuuuuaauauugauaugcuuauacacuuacacuuuaugcacaaaauguaggguuauaauaauguuaacauggacaugaucuucuuuauaauucuacuuugagugcugucuccauguuugauguaucugagcagguugcuccacagguagcucuaggagggcuggcaacuuagagguggggagcagagaauucucuuauccaacaucaacaucuuggucagauuugaacucuucaaucucuugcacucaaagcuuguuaagauaguuaagcgugcauaaguuaacuuccaauuuacauacucugcuuagaauuugggggaaaauuuagaaauauaauugacaggauuauuggaaauuuguuauaaugaaugaaacauuuugucauauaagauucauauuuacuucuuauacauuugauaaaguaaggcaugguugugguuaaucugguuuauuuuuguuccacaaguuaaauaaaucauaaaacuuga

SEQ ID NO: 770 - DNA, 6654 bp, Homo sapiens
aagtggaggcgtcgcgctggcgggcattcctgaagctgacagcattcgggccgagatgtctcgctccgtggccttagctgtgctcgcgctactctctctttctggcctggaggctatccagcgtgagtctctcctaccctcccgctctggtccttcctctcccgctctgcaccctctgtggccctcgctgtgctctctcgctccgtgacttcccttctccaagttctccttggtggcccgccgtggggctagtccagggctggatctcggggaagcggcggggtggcctgggagtggggaagggggtgcgcacccgggacgcgcgctacttgcccctttcggcggggagcaggggagacctttggcctacggcgacgggagggtcgggacaaagtttagggcgtcgataagcgtcagagcgccgaggttgggggagggtttctcttccgctctttcgcggggcctctggctcccccagcgcagctggagtgggggacgggtaggctcgtcccaaaggcgcggcgctgaggtttgtgaacgcgtggaggggcgcttggggtctgggggaggcgtcgcccgggtaagcctgtctgctgcggctctgcttcccttagactggagagctgtggacttcgtctaggcgcccgctaagttcgcatgtcctagcacctctgggtctatgtggggccacaccgtggggaggaaacagcacgcgacgtttgtagaatgcttggctgtgatacaaagcggtttcgaataattaacttatttgttcccatcacatgtcacttttaaaaaattataagaactacccgttattgacatctttctgtgtgccaaggactttatgtgctttgcgtcatttaattttgaaaacagttatcttccgccatagataactactatggttatcttctgcctctcacagatgaagaaactaaggcaccgagattttaagaaacttaattacacaggggataaatggcagcaatcgagattgaagtcaagcctaaccagggcttttgcgggagcgcatgccttttggctgtaattcgtgcatttttttttaagaaaaacgcctgccttctgcgtgagattctccagagcaaactgggcggcatgggccctgtggtcttttcgtacagagggcttcctctttggctctttgcctggttgtttccaagatgtactgtgcctcttactttcggttttgaaaacatgagggggttgggcgtggtagcttacgcctgtaatcccagcacttagggaggccgaggcgggaggatggcttgaggtccgtagttgagaccagcctggccaacatggtgaagcctggtctctacaaaaaataataacaaaaattagccgggtgtggtggctcgtgcctgtggtcccagctgctccggtggctgaggcgggaggatctcttgagcttaggcttttgagctatcatggcgccagtgcactccagcgtgggcaacagagcgagaccctgtctctcaaaaaagaaaaaaaaaaaaaaagaaagagaaaagaaaagaaagaaagaagtgaaggtttgtcagtcaggggagctgtaaaaccattaataaagataatccaagatggttaccaagactgttgaggacgccagagatcttgagcactttctaagtacctggcaatacactaagcgcgctcaccttttcctctggcaaaacatgatcgaaagcagaatgttttgatcatgagaaaattgcatttaatttgaatacaatttatttacaacataaaggataatgtatatatcaccaccattactggtatttgctggttatgttagatgtcattttaaaaaataacaatctgatatttaaaaaaaaatcttattttgaaaatttccaaagtaatacatgccatgcatagaccatttctggaagataccacaagaaacatgtaatgatgattgcctctgaaggtctattttcctcctctgacctgtgtgtgggttttgtttttgttttactgtgggcataaattaatttttcagttaagttttggaagcttaaataactctccaaaagtcataaagccagtaactggttgagcccaaattcaaacccagcctgtctgatacttgtcctcttcttagaaaagattacagtgatgctctcacaaaatcttgccgccttccctcaaacagagagttccaggcaggatgaatctgtgctctgatccctgaggcatttaatatgttcttattattagaagctcagatgcaaagagctctcttagcttttaatgttatgaaaaaaatcaggtcttcattagattccccaatccacctcttgatggggctagtagcctttccttaatgatagggtgtttctagagagatatatctggtcaaggtggcctggtactcctccttctccccacagcctcccagacaaggaggagtagctgccttttagtgatcatgtaccctgaatataagtgtatttaaaagaattttatacacatatatttagtgtcaatctgtatatttagtagcactaacacttctcttcattttcaatgaaaaatatagagtttataatattttcttcccacttccccatggatggtctagtcatgcctctcattttggaaagtactgtttctgaaacattaggcaatatattcccaacctggctagtttacagcaatcacctgtggatgctaattaaaacgcaaatcccactgtcacatgcattactccatttgatcataatggaaagtatgttctgtcccatttgccatagtcctcacctatccctgttgtattttatcgggtccaactcaaccatttaaggtatttgccagctcttgtatgcatttaggttttgtttctttgttttttagctcatgaaattaggtacaaagtcagagaggggtctggcatataaaacctcagcagaaataaagaggttttgttgtttggtaagaacataccttgggttggttgggcacggtggctcgtgcctgtaatcccaacactttgggaggccaaggcaggctgatcacttgaagttgggagttcaagaccagcctggccaacatggtgaaatcccgtctctactgaaaatacaaaaattaaccaggcatggtggtgtgtgcctgtagtcccaggaatcacttgaacccaggaggcggaggttgcagtgagctgagatctcaccactgcacactgcactccagcctgggcaatggaatgagattccatcccaaaaaataaaaaaataaaaaaataaagaacataccttgggttgatccacttaggaacctcagataataacatctgccacgtatagagcaattgctatgtcccaggcactctactagacacttcatacagtttagaaaatcagatgggtgtagatcaaggcaggagcaggaaccaaaaagaaaggcataaacataagaaaaaaaatggaaggggtggaaacagagtacaataacatgagtaatttgatgggggctattatgaactgagaaatgaactttgaaaagtatcttggggccaaatcatgtagactcttgagtgatgtgttaaggaatgctatgagtgctgagagggcatcagaagtccttgagagcctccagagaaaggctcttaaaaatgcagcgcaatctccagtgacagaagatactgctagaaatctgctagaaaaaaaacaaaaaaggcatgtatagaggaattatgagggaaagataccaagtcacggtttattcttcaaaatggaggtggcttgttgggaaggtggaagctcatttggccagagtggaaatggaattgggagaaatcgatgaccaaatgtaaacacttggtgcctgatatagcttgacaccaagttagccccaagtgaaataccctggcaatattaatgtgtcttttcccgatattcctcaggtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggtaagtcttacattcttttgtaagctgctgaaagttgtgtatgagtagtcatatcataaagctgctttgatataaaaaaggtctatggccatactaccctgaatgagtcccatcccatctgatataaacaatctgcatattgggattgtcagggaatgttcttaaagatcagattagtggcacctgctgagatactgatgcacagcatggtttctgaaccagtagtttccctgcagttgagcagggagcagcagcagcacttgcacaaatacatatacactcttaacacttcttacctactggcttcctctagcttttgtggcagcttcaggtatatttagcactgaacgaacatctcaagaaggtataggcctttgtttgtaagtcctgctgtcctagcatcctataatcctggacttctccagtactttctggctggattggtatctgaggctagtaggaagggcttgttcctgctgggtagctctaaacaatgtattcatgggtaggaacagcagcctattctgccagccttatttctaaccattttagacatttgttagtacatggtattttaaaagtaaaacttaatgtcttccttttttttctccactgtctttttcatagatcgagacatgtaagcagcatcatggaggtaagtttttgaccttgagaaaatgtttttgtttcactgtcctgaggactatttatagacagctctaacatgataaccctcactatgtggagaacattgacagagtaacattttagcagggaaagaagaatcctacagggtcatgttcccttctcctgtggagtggcatgaagaaggtgtatggccccaggtatggccatattactgaccctctacagagagggcaaaggaactgccagtatggtattgcaggataaaggcaggtggttacccacattacctgcaaggctttgatctttcttctgccatttccacattggacatctctgctgaggagagaaaatgaaccactcttttcctttgtataatgttgttttattcttcagacagaagagaggagttatacagctctgcagacatcccattcctgtatggggactgtgtttgcctcttagaggttcccaggccactagaggagataaagggaaacagattgttataacttgatataatgatactataatagatgtaactacaaggagctccagaagcaagagagagggaggaacttggacttctctgcatctttagttggagtccaaaggcttttcaatgaaattctactgcccagggtacattgatgctgaaaccccattcaaatctcctgttatattctagaacagggaattgatttgggagagcatcaggaaggtggatgatctgcccagtcacactgttagtaaattgtagagccaggacctgaactctaatatagtcatgtgttacttaatgacggggacatgttctgagaaatgcttacacaaacctaggtgttgtagcctactacacgcataggctacatggtatagcctattgctcctagactacaaacctgtacagcctgttactgtactgaatactgtgggcagttgtaacacaatggtaagtatttgtgtatctaaacatagaagttgcagtaaaaatatgctattttaatcttatgagaccactgtcatatatacagtccatcattgaccaaaacatcatatcagcattttttcttctaagattttgggagcaccaaagggatacactaacaggatatactctttataatgggtttggagaactgtctgcagctacttcttttaaaaaggtgatctacacagtagaaattagacaagtttggtaatgagatctgcaatccaaataaaataaattcattgctaacctttttcttttcttttcaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttga

SEQ ID NO: 771 - DNA, 1698 bp, Artificial Sequence
  encodes HLA-A*02:01:01:01
cagaagcagaggggtcagggcgaagtcccagggccccaggcgtggctctcagggtctcaggccccgaaggcggtgtatggattggggagtcccagccttggggattccccaactccgcagtttcttttctccctctcccaacctatgtagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgatgtggaggaggaagagctcagatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaa

SEQ ID NO: 772 - DNA, 3217 bp, Homo sapiens
atggccgtcatggcgccccgaaccctcgtcctgctactctcgggggctctggccctgacccagacctgggcgggtgagtgcggggtcgggagggaaacggcctctgtggggagaagcaacgggcccgcctggcgggggcgcaggacccgggaagccgcgccgggaggagggtcgggcgggtctcagccactcctcgtccccaggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggtgagtgaccccggcccggggcgcaggtcacgacctctcatcccccacggacgggccaggtcgcccacagtctccgggtccgagatccgccccgaagccgcgggaccccgagacccttgccccgggagaggcccaggcgcctttacccggtttcattttcagtttaggccaaaaatccccccaggttggtcggggcggggcggggctcgggggaccgggctgaccgcggggtccgggccaggttctcacaccgtccagaggatgtatggctgcgacgtggggtcggactggcgcttcctccgcgggtaccaccagtacgcctacgacggcaaggattacatcgccctgaaagaggacctgcgctctttgaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacgggtaccaggggccacggggcgcctccctgatcgcctgtagatctcccgggctggcctcccacaaggaggggagacaattgggaccaacactagaatatcgccctccctctggtcctgagggagaggaatcctcctgggtttccagatcctgtaccagagagtgactctgaggttccgccctgctctctgacacaattaagggataaaatctctgaaggaatgacgggaagacgatccctcgaatactgatgagtggttccctttgacacacacaggcagcagccttgggcccgtgacttttcctctcaggccttgttctctgcttcacactcaatgtgtgtgggggtctgagtccagcacttctgagtccttcagcctccactcaggtcaggaccagaagtcgctgttccctcttcagggactagaattttccacggaataggagattatcccaggtgcctgtgtccaggctggtgtctgggttctgtgctcccttccccatcccaggtgtcctgtccattctcaagatagccacatgtgtgctggaggagtgtcccatgacagatgcaaaatgcctgaatgatctgactcttcctgacagacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatggggtaaggagggagacgggggtgtcatgtcttttagggaaagcaggagcctctctgacctttagcagggtcagggcccctcaccttcccctcttttcccagagccgtcttcccagcccaccatccccatcgtgggcatcattgctggcctggttctctttggagctgtgatcactggagctgtggtcgctgctgtgatgtggaggaggaagagctcaggtggggaaggggtgaagggtgggtctgagatttcttgtctcactgagggttccaagacccaggtagaagtgtgccctgcctcgttactgggaagcaccacccacaattatgggcctacccagcctgggccctgtgtgccagcacttactcttttgtaaagcacctgttaaaatgaaggacagatttatcaccttgattacagcggtgatgggacctgatcccagcagtcacaagtcacaggggaaggtccctgaggaccttcaggagggcggttggtccaggacccacacctgctttcttcatgtttcctgatcccgccctgggtctgcagtcacacatttctggaaacttctctgaggtccaagacttggaggttcctctaggaccttaaggccctgactcctttctggtatctcacaggacattttcttcccacagatagaaaaggagggagctactctcaggctgcaagtaagtatgaaggaggctgatgcctgaggtccttgggatattgtgtttgggagcccatgggggagctcacccaccccacaattcctcctctagccacatcttctgtgggatctgaccaggttctgtttttgttctaccccaggcagtgacagtgcccagggctctgatgtgtctctcacagcttgtaaaggtgagagcctggagggcctgatgtgtgttgggtgttgggcggaacagtggacacagctgtgctatggggtttctttccattggatgtattgagcatgcgatgggctgtttaaagtgtgacccctcactgtgacagatacgaatttgttcatgaatatttttttctatagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaa

SEQ ID NO: 773 - DNA, 83 bp, Artificial Sequence
  encodes scaffold sequence
gttttagagctagaaatagcaagttaaaataaggctagtccgttatcaacttgaaaaagtggcaccgagtcggtgcttttttt

SEQ ID NO: 774 - DNA, 20 bp, Artificial Sequence
  Guide Nucleic Acid Targeting Sequence
tggacgacacgcagttcgtg

SEQ ID NO: 775 - DNA, 20 bp, Artificial Sequence
  Guide Nucleic Acid Targeting Sequence
cagatacctggagaacggga

SEQ ID NO: 776 - DNA, 20 bp, Artificial Sequence
  Guide Nucleic Acid Targeting Sequence
tcccgttctccaggtatctg

SEQ ID NO: 777 - DNA, 20 bp, Artificial Sequence
  Guide Nucleic Acid Targeting Sequence
ccgccgcggtccaagagcgc

SEQ ID NO: 778 - DNA, 20 bp, Artificial Sequence
  Guide Nucleic Acid Targeting Sequence
cctgcgctcttggaccgcgg

SEQ ID NO: 779 - DNA, 21 bp, Artificial Sequence
  Guide Nucleic Acid Targeting Sequence
ggacctgcgctcttggaccgc

SEQ ID NO: 780 - DNA, 23 bp, Artificial Sequence
  Guide Nucleic Acid Targeting Sequence
aaggagacgctgcagcgcacggg

SEQ ID NO: 781 - DNA, 23 bp, Artificial Sequence
  Guide Nucleic Acid Targeting Sequence
gaaggagacgctgcagcgcacgg

SEQ ID NO: 782 - DNA, 23 bp, Artificial Sequence
  Guide Nucleic Acid Targeting Sequence
gcgggcgccgtggatagagcagg

SEQ ID NO: 783 - DNA, 23 bp, Artificial Sequence
  Guide Nucleic Acid Targeting Sequence
tgctctatccacggcgcccgcgg

SEQ ID NO: 784 - DNA, 23 bp, Artificial Sequence
  Guide Nucleic Acid Targeting Sequence
cgatgaagcggggctccccgcgg

SEQ ID NO: 785 - DNA, 23 bp, Artificial Sequence
  Guide Nucleic Acid Targeting Sequence
cgtgtcccggcccggccgcgggg

SEQ ID NO: 786 - DNA, 23 bp, Artificial Sequence
  Guide Nucleic Acid Targeting Sequence
cggctccatcctctggctcgcgg

SEQ ID NO: 787 - DNA, 23 bp, Artificial Sequence
  Guide Nucleic Acid Targeting Sequence
gatgtaatccttgccgtcgtagg

SEQ ID NO: 788 - DNA, 23 bp, Artificial Sequence
  Guide Nucleic Acid Targeting Sequence
acagcgacgccgcgagccagagg

SEQ ID NO: 789 - DNA, 23 bp, Artificial Sequence
  Guide Nucleic Acid Targeting Sequence
ggatggagccgcgggcgccgtgg

SEQ ID NO: 790 - DNA, 23 bp, Artificial Sequence
  Guide Nucleic Acid Targeting Sequence
ggcgccgtggatagagcaggagg

SEQ ID NO: 791 - DNA, 23 bp, Artificial Sequence
  Guide Nucleic Acid Targeting Sequence
gcgccgtggatagagcaggaggg

SEQ ID NO: 792 - DNA, 23 bp, Artificial Sequence
  Guide Nucleic Acid Targeting Sequence
cggctactacaaccagagcgagg

SEQ ID NO: 793 - DNA, 23 bp, Artificial Sequence
  Guide Nucleic Acid Targeting Sequence
ctggttgtagtagccgcgcaggg

SEQ ID NO: 794 - DNA, 23 bp, Artificial Sequence
  Guide Nucleic Acid Targeting Sequence
tactacaaccagagcgaggccgg

SEQ ID NO: 795 - DNA, 23 bp, Artificial Sequence
  Guide Nucleic Acid Targeting Sequence
ctacctggagggcacgtgcgtgg

SEQ ID NO: 796 - DNA, 23 bp, Artificial Sequence
  Guide Nucleic Acid Targeting Sequence
cacgcacgtgccctccaggtagg

SEQ ID NO: 797 - DNA, 23 bp, Artificial Sequence
  Guide Nucleic Acid Targeting Sequence
gcagggtccccaggtccactcgg

SEQ ID NO: 798 - DNA, 23 bp, Artificial Sequence
  Guide Nucleic Acid Targeting Sequence
gtggacctggggaccctgcgcgg

SEQ ID NO: 799 - DNA, 23 bp, Artificial Sequence
  Guide Nucleic Acid Targeting Sequence
tggagggcacgtgcgtggagtgg

SEQ ID NO: 800 - DNA, 23 bp, Artificial Sequence
  Guide Nucleic Acid Targeting Sequence
gtatggctgcgacgtggggtcgg

SEQ ID NO: 801 - DNA, 23 bp, Artificial Sequence
  Guide Nucleic Acid Targeting Sequence
ctgagctgccatgtccgccgcgg

SEQ ID NO: 802 - DNA, 23 bp, Artificial Sequence
  Guide Nucleic Acid Targeting Sequence
ggattacatcgccctgaaagagg

SEQ ID NO: 803 - DNA, 23 bp, Artificial Sequence
  Guide Nucleic Acid Targeting Sequence
caagtgggaggcggcccatgtgg

SEQ ID NO: 804 - DNA, 23 bp, Artificial Sequence
  Guide Nucleic Acid Targeting Sequence
gtgggaggcggcccatgtggcgg

SEQ ID NO: 805 - DNA, 23 bp, Artificial Sequence
  Guide Nucleic Acid Targeting Sequence
cagttgagagcctacctggaggg

SEQ ID NO: 806 - DNA, 23 bp, Artificial Sequence
  Guide Nucleic Acid Targeting Sequence
gcagttgagagcctacctggagg

SEQ ID NO: 807 - DNA, 23 bp, Artificial Sequence
  Guide Nucleic Acid Targeting Sequence
taccaccagtacgcctacgacgg

SEQ ID NO: 808 - DNA, 23 bp, Artificial Sequence
  Guide Nucleic Acid Targeting Sequence
tgccgtcgtaggcgtactggtgg

SEQ ID NO: 809 - DNA, 23 bp, Artificial Sequence
  Guide Nucleic Acid Targeting Sequence
ccagtacgcctacgacggcaagg

SEQ ID NO: 810 - DNA, 23 bp, Artificial Sequence
  Guide Nucleic Acid Targeting Sequence
ggatgtgaagaaatacctcatgg

SEQ ID NO: 811 - DNA, 23 bp, Artificial Sequence
  Guide Nucleic Acid Targeting Sequence
atttcttcacatccgtgtcccgg

SEQ ID NO: 812 - DNA, 23 bp, Artificial Sequence
  Guide Nucleic Acid Targeting Sequence
aggcgtactggtggtacccgcgg

SEQ ID NO: 813 - DNA, 23 bp, Artificial Sequence
  Guide Nucleic Acid Targeting Sequence
cgtactggtggtacccgcggagg

SEQ ID NO: 814 - DNA, 23 bp, Artificial Sequence
  Guide Nucleic Acid Targeting Sequence
gaggatgtatggctgcgacgtgg

SEQ ID NO: 815 - DNA, 23 bp, Artificial Sequence
  Guide Nucleic Acid Targeting Sequence
ggatgtatggctgcgacgtgggg

SEQ ID NO: 816 - DNA, 23 bp, Artificial Sequence
  Guide Nucleic Acid Targeting Sequence
ctcagaccaccaagcacaagtgg

SEQ ID NO: 817 - DNA, 23 bp, Artificial Sequence
  Guide Nucleic Acid Targeting Sequence
tcagaccaccaagcacaagtggg

SEQ ID NO: 818 - DNA, 23 bp, Artificial Sequence
  Guide Nucleic Acid Targeting Sequence
caccaagcacaagtgggaggcgg

SEQ ID NO: 819 - DNA, 23 bp, Artificial Sequence
  Guide Nucleic Acid Targeting Sequence
gaccaccaagcacaagtgggagg

SEQ ID NO: 820 - DNA, 23 bp, Artificial Sequence
  Guide Nucleic Acid Targeting Sequence
gagccccgcttcatcgcagtggg

SEQ ID NO: 821 - DNA, 23 bp, Artificial Sequence
  Guide Nucleic Acid Targeting Sequence
gtagcccactgcgatgaagcggg

SEQ ID NO: 822 - DNA, 23 bp, Artificial Sequence
  Guide Nucleic Acid Targeting Sequence
tagcccactgcgatgaagcgggg

SEQ ID NO: 823 - DNA, 23 bp, Artificial Sequence
  Guide Nucleic Acid Targeting Sequence
cgtagcccactgcgatgaagcgg

SEQ ID NO: 824 - DNA, 23 bp, Artificial Sequence
  Guide Nucleic Acid Targeting Sequence
cttcatcgcagtgggctacgtgg

SEQ ID NO: 825 - DNA, 23 bp, Artificial Sequence
  Guide Nucleic Acid Targeting Sequence
ggagccccgcttcatcgcagtgg

SEQ ID NO: 826 - DNA, 23 bp, Artificial Sequence
  Guide Nucleic Acid Targeting Sequence
cggggagacacggaaagtgaagg

SEQ ID NO: 827 - DNA, 23 bp, Artificial Sequence
  Guide Nucleic Acid Targeting Sequence
agtattgggacggggagacacgg

SEQ ID NO: 828 - DNA, 23 bp, Artificial Sequence
  Guide Nucleic Acid Targeting Sequence
agggtccggagtattgggacggg

SEQ ID NO: 829 - DNA, 23 bp, Artificial Sequence
  Guide Nucleic Acid Targeting Sequence
gagggtccggagtattgggacgg

SEQ ID NO: 830 - DNA, 23 bp, Artificial Sequence
  Guide Nucleic Acid Targeting Sequence
ggaccctcctgctctatccacgg

SEQ ID NO: 831 - DNA, 23 bp, Artificial Sequence
  Guide Nucleic Acid Targeting Sequence
gtggatagagcaggagggtccgg

SEQ ID NO: 832 - DNA, 23 bp, Artificial Sequence
  Guide Nucleic Acid Targeting Sequence
agactcaccgagtggacctgggg

SEQ ID NO: 833 - DNA, 23 bp, Artificial Sequence
  Guide Nucleic Acid Targeting Sequence
cactcggtgagtctgtgagtggg

SEQ ID NO: 834 - DNA, 23 bp, Artificial Sequence
  Guide Nucleic Acid Targeting Sequence
cagactcaccgagtggacctggg

SEQ ID NO: 835 - DNA, 23 bp, Artificial Sequence
  Guide Nucleic Acid Targeting Sequence
ccactcacagactcaccgagtgg

SEQ ID NO: 836 - DNA, 23 bp, Artificial Sequence
  Guide Nucleic Acid Targeting Sequence
ccactcggtgagtctgtgagtgg

SEQ ID NO: 837 - DNA, 23 bp, Artificial Sequence
  Guide Nucleic Acid Targeting Sequence
tcggactggcgcttcctccgcgg

SEQ ID NO: 838 - DNA, 23 bp, Artificial Sequence
  Guide Nucleic Acid Targeting Sequence
gcagccatacatcctctggacgg

SEQ ID NO: 839 - DNA, 23 bp, Artificial Sequence
  Guide Nucleic Acid Targeting Sequence
tctcaactgctccgccacatggg

SEQ ID NO: 840 - DNA, 23 bp, Artificial Sequence
  Guide Nucleic Acid Targeting Sequence
accctcatgctgcacatggcagg

SEQ ID NO: 841 - DNA, 23 bp, Artificial Sequence
  Guide Nucleic Acid Targeting Sequence
acctgccatgtgcagcatgaggg

SEQ ID NO: 842 - DNA, 23 bp, Artificial Sequence
  Guide Nucleic Acid Targeting Sequence
cacctgccatgtgcagcatgagg

SEQ ID NO: 843 - DNA, 23 bp, Artificial Sequence
  Guide Nucleic Acid Targeting Sequence
ggaggaccagacccaggacacgg

SEQ ID NO: 844 - DNA, 23 bp, Artificial Sequence
  Guide Nucleic Acid Targeting Sequence
ggatggggaggaccagacccagg

SEQ ID NO: 845 - DNA, 23 bp, Artificial Sequence
  Guide Nucleic Acid Targeting Sequence
gacctggcagcgggatggggagg

SEQ ID NO: 846 - DNA, 23 bp, Artificial Sequence
  Guide Nucleic Acid Targeting Sequence
agatcacactgacctggcagcgg

SEQ ID NO: 847 - DNA, 23 bp, Artificial Sequence
  Guide Nucleic Acid Targeting Sequence
gatcacactgacctggcagcggg

SEQ ID NO: 848 - DNA, 23 bp, Artificial Sequence
  Guide Nucleic Acid Targeting Sequence
aggtcagtgtgatctccgcaggg

SEQ ID NO: 849 - DNA, 23 bp, Artificial Sequence
  Guide Nucleic Acid Targeting Sequence
aagcccctcaccctgagatgggg

SEQ ID NO: 850 - DNA, 23 bp, Artificial Sequence
  Guide Nucleic Acid Targeting Sequence
ctgcggagatcacactgacctgg

SEQ ID NO: 851 - DNA, 23 bp, Artificial Sequence
  Guide Nucleic Acid Targeting Sequence
cagcaatgatgcccacgatgggg

SEQ ID NO: 852 - DNA, 23 bp, Artificial Sequence
  Guide Nucleic Acid Targeting Sequence
ccagcaatgatgcccacgatggg

SEQ ID NO: 853 - DNA, 23 bp, Artificial Sequence
  Guide Nucleic Acid Targeting Sequence
gccagcaatgatgcccacgatgg

SEQ ID NO: 854 - DNA, 23 bp, Artificial Sequence
  Guide Nucleic Acid Targeting Sequence
ggatggaaccttccagaagtggg

SEQ ID NO: 855 - DNA, 23 bp, Artificial Sequence
  Guide Nucleic Acid Targeting Sequence
gggatggaaccttccagaagtgg

SEQ ID NO: 856 - DNA, 23 bp, Artificial Sequence
  Guide Nucleic Acid Targeting Sequence
atgcccacgatggggatggtggg

SEQ ID NO: 857 - DNA, 23 bp, Artificial Sequence
  Guide Nucleic Acid Targeting Sequence
cagcccaccatccccatcgtggg

SEQ ID NO: 858 - DNA, 23 bp, Artificial Sequence
  Guide Nucleic Acid Targeting Sequence
ccagcccaccatccccatcgtgg

SEQ ID NO: 859 - DNA, 23 bp, Artificial Sequence
  Guide Nucleic Acid Targeting Sequence
gatgcccacgatggggatggtgg

SEQ ID NO: 860 - DNA, 23 bp, Artificial Sequence
  Guide Nucleic Acid Targeting Sequence
cagggcccagcacctcagggtgg

SEQ ID NO: 861 - DNA, 23 bp, Artificial Sequence
  Guide Nucleic Acid Targeting Sequence
aatgatgcccacgatggggatgg

SEQ ID NO: 862 - DNA, 23 bp, Artificial Sequence
  Guide Nucleic Acid Targeting Sequence
ggccctgacccagacctgggcgg

SEQ ID NO: 863 - DNA, 23 bp, Artificial Sequence
  Guide Nucleic Acid Targeting Sequence
gacccaggacacggagctcgtgg

SEQ ID NO: 864 - DNA, 23 bp, Artificial Sequence
  Guide Nucleic Acid Targeting Sequence
acacggagctcgtggagaccagg

SEQ ID NO: 865 - DNA, 23 bp, Artificial Sequence
  Guide Nucleic Acid Targeting Sequence
cgtggagaccaggcctgcagggg

SEQ ID NO: 866 - DNA, 23 bp, Artificial Sequence
  Guide Nucleic Acid Targeting Sequence
tcgtggagaccaggcctgcaggg

SEQ ID NO: 867 - DNA, 23 bp, Artificial Sequence
  Guide Nucleic Acid Targeting Sequence
agctgtgatcactggagctgtgg

SEQ ID NO: 868 - DNA, 23 bp, Artificial Sequence
  Guide Nucleic Acid Targeting Sequence
aaaaggagggagctactctcagg

SEQ ID NO: 869 - DNA, 23 bp, Artificial Sequence
  Guide Nucleic Acid Targeting Sequence
atgtggaggaggaagagctcagg

SEQ ID NO: 870 - DNA, 23 bp, Artificial Sequence
  Guide Nucleic Acid Targeting Sequence
gtgtctctcacagcttgtaaagg

SEQ ID NO: 871 - DNA, 23 bp, Artificial Sequence
  Guide Nucleic Acid Targeting Sequence
gagagacacatcagagccctggg

SEQ ID NO: 872 - DNA, 23 bp, Artificial Sequence
  Guide Nucleic Acid Targeting Sequence
ctccgcagggtagaagctcaggg

SEQ ID NO: 873 - DNA, 23 bp, Artificial Sequence
  Guide Nucleic Acid Targeting Sequence
ggccctgagcttctaccctgcgg

SEQ ID NO: 874 - DNA, 23 bp, Artificial Sequence
  Guide Nucleic Acid Targeting Sequence
gctcagggcccagcacctcaggg

SEQ ID NO: 875 - DNA, 23 bp, Artificial Sequence
  Guide Nucleic Acid Targeting Sequence
tatctctgctcctgtccagaagg

SEQ ID NO: 876 - DNA, 23 bp, Artificial Sequence
  Guide Nucleic Acid Targeting Sequence
agtagcaggacgagggttcgggg

SEQ ID NO: 877 - DNA, 23 bp, Artificial Sequence
  Guide Nucleic Acid Targeting Sequence
ccccgagagtagcaggacgaggg

SEQ ID NO: 878 - DNA, 23 bp, Artificial Sequence
  Guide Nucleic Acid Targeting Sequence
ccctcgtcctgctactctcgggg

SEQ ID NO: 879 - DNA, 23 bp, Artificial Sequence
  Guide Nucleic Acid Targeting Sequence
cctcgtcctgctactctcggggg

SEQ ID NO: 880 - DNA, 23 bp, Artificial Sequence
  Guide Nucleic Acid Targeting Sequence
ctgtggtcgctgctgtgatgtgg

SEQ ID NO: 881 - DNA, 23 bp, Artificial Sequence
  Guide Nucleic Acid Targeting Sequence
tcgctgctgtgatgtggaggagg

SEQ ID NO: 882 - DNA, 23 bp, Artificial Sequence
  Guide Nucleic Acid Targeting Sequence
tggtcgctgctgtgatgtggagg

SEQ ID NO: 883 - DNA, 23 bp, Artificial Sequence
  Guide Nucleic Acid Targeting Sequence
cacagccgcccacttctggaagg

SEQ ID NO: 884 - DNA, 23 bp, Artificial Sequence
  Guide Nucleic Acid Targeting Sequence
ccagaagtgggcggctgtggtgg

SEQ ID NO: 885 - DNA, 23 bp, Artificial Sequence
  Guide Nucleic Acid Targeting Sequence
tggaaccttccagaagtgggcgg

SEQ ID NO: 886 - DNA, 23 bp, Artificial Sequence
  Guide Nucleic Acid Targeting Sequence
tcacagctccaaagagaaccagg

SEQ ID NO: 887 - DNA, 23 bp, Artificial Sequence
  Guide Nucleic Acid Targeting Sequence
ctgaccatgaagccaccctgagg

SEQ ID NO: 888 - DNA, 23 bp, Artificial Sequence
  Guide Nucleic Acid Targeting Sequence
gcaaaccctcatgctgcacatgg

SEQ ID NO: 889 - DNA, 23 bp, Artificial Sequence
  Guide Nucleic Acid Targeting Sequence
tgaagccaccctgaggtgctggg

SEQ ID NO: 890 - DNA, 23 bp, Artificial Sequence
  Guide Nucleic Acid Targeting Sequence
ggtgagtcatatgcgttttgggg

SEQ ID NO: 891 - DNA, 23 bp, Artificial Sequence
  Guide Nucleic Acid Targeting Sequence
gtgagtcatatgcgttttggggg

SEQ ID NO: 892 - DNA, 23 bp, Artificial Sequence
  Guide Nucleic Acid Targeting Sequence
cttcatggtcagagacagcgtgg

SEQ ID NO: 893 - DNA, 23 bp, Artificial Sequence
  Guide Nucleic Acid Targeting Sequence
tctggccctgacccagacctggg

SEQ ID NO: 894 - DNA, 20 bp, Artificial Sequence
  sequence targeting B2M
cgcgagcacagctaaggcca

SEQ ID NO: 895 - DNA, 20 bp, Artificial Sequence
  sequence targeting B2M
gagtagcgcgagcacagcta

SEQ ID NO: 896 - DNA, 20 bp, Artificial Sequence
  sequence targeting B2M
agggtaggagagactcacgc

SEQ ID NO: 897 - DNA, 20 bp, Artificial Sequence
  sequence targeting B2M
ctgaatctttggagtacctg

SEQ ID NO: 898 - DNA, 20 bp, Artificial Sequence
  sequence targeting B2M
tcacgtcatccagcagagaa

SEQ ID NO: 899 - DNA, 20 bp, Artificial Sequence
  sequence targeting B2M
tcctgaattgctatgtgtct

SEQ ID NO: 900 - DNA, 20 bp, Artificial Sequence
  sequence targeting B2M
aagtcaacttcaatgtcgga

SEQ ID NO: 901 - DNA, 20 bp, Artificial Sequence
  sequence targeting B2M
gtcttttcccgatattcctc

SEQ ID NO: 902 - DNA, 20 bp, Artificial Sequence
  sequence targeting B2M
tggagtacctgaggaatatc

SEQ ID NO: 903 - DNA, 20 bp, Artificial Sequence
  sequence targeting B2M
cagcccaagatagttaagtg

SEQ ID NO: 904 - DNA, 20 bp, Artificial Sequence
  sequence targeting B2M
acaaagtcacatggttcaca

SEQ ID NO: 905 - DNA, 20 bp, Artificial Sequence
  sequence targeting B2M
actctctctttctggcctgg

SEQ ID NO: 906 - DNA, 20 bp, Artificial Sequence
  sequence targeting B2M
tgggctgtgacaaagtcaca

SEQ ID NO: 907 - DNA, 20 bp, Artificial Sequence
  sequence targeting B2M
ggccgagatgtctcgctccg

SEQ ID NO: 908 - DNA, 20 bp, Artificial Sequence
  sequence targeting B2M
cagtaagtcaacttcaatgt

SEQ ID NO: 909 - DNA, 20 bp, Artificial Sequence
  sequence targeting B2M
actcacgctggatagcctcc

SEQ ID NO: 910 - DNA, 20 bp, Artificial Sequence
  sequence targeting B2M
catactcatctttttcagtg

SEQ ID NO: 911 - DNA, 20 bp, Artificial Sequence
  sequence targeting B2M
cacagcccaagatagttaag

SEQ ID NO: 912 - DNA, 20 bp, Artificial Sequence
  sequence targeting B2M
ttcagacttgtctttcagca

SEQ ID NO: 913 - DNA, 20 bp, Artificial Sequence
  sequence targeting B2M
agtcacatggttcacacggc

SEQ ID NO: 914 - DNA, 20 bp, Artificial Sequence
  sequence targeting B2M
atactcatctttttcagtgg

SEQ ID NO: 915 - DNA, 20 bp, Artificial Sequence
  sequence targeting B2M
ggcatactcatctttttcag

SEQ ID NO: 916 - DNA, 20 bp, Artificial Sequence
  sequence targeting B2M
acagcccaagatagttaagt

SEQ ID NO: 917 - DNA, 20 bp, Artificial Sequence
  sequence targeting B2M
gctactctctctttctggcc

SEQ ID NO: 918 - DNA, 20 bp, Artificial Sequence
  sequence targeting B2M
tggagagagaattgaaaaag

SEQ ID NO: 919 - DNA, 20 bp, Artificial Sequence
  sequence targeting B2M
acttgtctttcagcaaggac

SEQ ID NO: 920 - DNA, 20 bp, Artificial Sequence
  sequence targeting B2M
gaagttgacttactgaagaa

SEQ ID NO: 921 - DNA, 20 bp, Artificial Sequence
  sequence targeting B2M
ggccacggagcgagacatct

SEQ ID NO: 922 - DNA, 20 bp, Artificial Sequence
  sequence targeting B2M
gcatactcatctttttcagt

SEQ ID NO: 923 - DNA, 20 bp, Artificial Sequence
  sequence targeting B2M
cgtgagtaaacctgaatctt

SEQ ID NO: 924 - DNA, 20 bp, Artificial Sequence
  sequence targeting B2M
ttaccccacttaactatctt

SEQ ID NO: 925 - DNA, 20 bp, Artificial Sequence
  sequence targeting B2M
ttggagtacctgaggaatat

SEQ ID NO: 926 - DNA, 20 bp, Artificial Sequence
  sequence targeting B2M
acccagacacatagcaattc

SEQ ID NO: 927 - DNA, 20 bp, Artificial Sequence
  sequence targeting B2M
tttgactttccattctctgc

SEQ ID NO: 928 - DNA, 20 bp, Artificial Sequence
  sequence targeting B2M
ttcctgaattgctatgtgtc

SEQ ID NO: 929 - DNA, 20 bp, Artificial Sequence
  sequence targeting B2M
ctcaggtactccaaagattc

SEQ ID NO: 930 - DNA, 20 bp, Artificial Sequence
  sequence targeting B2M
cttaccccacttaactatct

SEQ ID NO: 931 - DNA, 20 bp, Artificial Sequence
  sequence targeting B2M
ctcgcgctactctctctttc

SEQ ID NO: 932 - DNA, 20 bp, Artificial Sequence
  sequence targeting B2M
tcgatctatgaaaaagacag

SEQ ID NO: 933 - DNA, 20 bp, Artificial Sequence
  sequence targeting B2M
gagacatgtaagcagcatca

SEQ ID NO: 934 - DNA, 20 bp, Artificial Sequence
  sequence targeting B2M
acatgtaagcagcatcatgg

SEQ ID NO: 935 - DNA, 20 bp, Artificial Sequence
  sequence targeting B2M
gaagtcctagaatgagcgcc

SEQ ID NO: 936 - DNA, 20 bp, Artificial Sequence
  sequence targeting B2M
gagcgcccggtgtcccaagc

SEQ ID NO: 937 - DNA, 20 bp, Artificial Sequence
  sequence targeting B2M
agcgcccggtgtcccaagct

SEQ ID NO: 938 - DNA, 20 bp, Artificial Sequence
  sequence targeting B2M
gcgcccggtgtcccaagctg

SEQ ID NO: 939 - DNA, 20 bp, Artificial Sequence
  sequence targeting B2M
ctggggcgcgcaccccagat

SEQ ID NO: 940 - DNA, 20 bp, Artificial Sequence
  sequence targeting B2M
gggcgcgcaccccagatcgg

SEQ ID NO: 941 - DNA, 20 bp, Artificial Sequence
  sequence targeting B2M
ggcgcgcaccccagatcgga

SEQ ID NO: 942 - DNA, 20 bp, Artificial Sequence
  sequence targeting B2M
catcacgagactctaagaaa

SEQ ID NO: 943 - DNA, 20 bp, Artificial Sequence
  sequence targeting B2M
taagaaaaggaaactgaaaa

SEQ ID NO: 944 - DNA, 20 bp, Artificial Sequence
  sequence targeting B2M
aagaaaaggaaactgaaaac

SEQ ID NO: 945 - DNA, 20 bp, Artificial Sequence
  sequence targeting B2M
gaaagtccctctctctaacc

SEQ ID NO: 946 - DNA, 20 bp, Artificial Sequence
  sequence targeting B2M
ctaacctggcactgcgtcgc

SEQ ID NO: 947 - DNA, 20 bp, Artificial Sequence
  sequence targeting B2M
ctggcactgcgtcgctggct

SEQ ID NO: 948 - DNA, 20 bp, Artificial Sequence
  sequence targeting B2M
tgcgtcgctggcttggagac

SEQ ID NO: 949 - DNA, 20 bp, Artificial Sequence
  sequence targeting B2M
gctggcttggagacaggtga

SEQ ID NO: 950 - DNA, 20 bp, Artificial Sequence
  sequence targeting B2M
gagacaggtgacggtccctg

SEQ ID NO: 951 - DNA, 20 bp, Artificial Sequence
  sequence targeting B2M
agacaggtgacggtccctgc

SEQ ID NO: 952 - DNA, 20 bp, Artificial Sequence
  sequence targeting B2M
cctgcgggccttgtcctgat

SEQ ID NO: 953 - DNA, 20 bp, Artificial Sequence
  sequence targeting B2M
cgggccttgtcctgattggc

SEQ ID NO: 954 - DNA, 20 bp, Artificial Sequence
  sequence targeting B2M
gggccttgtcctgattggct

SEQ ID NO: 955 - DNA, 20 bp, Artificial Sequence
  sequence targeting B2M
gggcacgcgtttaatataag

SEQ ID NO: 956 - DNA, 20 bp, Artificial Sequence
  sequence targeting B2M
cacgcgtttaatataagtgg

SEQ ID NO: 957 - DNA, 20 bp, Artificial Sequence
  sequence targeting B2M
tataagtggaggcgtcgcgc

SEQ ID NO: 958 - DNA, 20 bp, Artificial Sequence
  sequence targeting B2M
aagtggaggcgtcgcgctgg

SEQ ID NO: 959 - DNA, 20 bp, Artificial Sequence
  sequence targeting B2M
agtggaggcgtcgcgctggc

SEQ ID NO: 960 - DNA, 20 bp, Artificial Sequence
  sequence targeting B2M
ttcctgaagctgacagcatt

SEQ ID NO: 961 - DNA, 20 bp, Artificial Sequence
  sequence targeting B2M
tcctgaagctgacagcattc

SEQ ID NO: 962 - DNA, 20 bp, Artificial Sequence
  sequence targeting B2M
gcccgaatgctgtcagcttc

SEQ ID NO: 963 - DNA, 20 bp, Artificial Sequence
  sequence targeting B2M
aaacgcgtgcccagccaatc

SEQ ID NO: 964 - DNA, 20 bp, Artificial Sequence
  sequence targeting B2M
gtgcccagccaatcaggaca

SEQ ID NO: 965 - DNA, 20 bp, Artificial Sequence
  sequence targeting B2M
ccaatcaggacaaggcccgc

SEQ ID NO: 966 - DNA, 20 bp, Artificial Sequence
  sequence targeting B2M
caatcaggacaaggcccgca

SEQ ID NO: 967 - DNA, 20 bp, Artificial Sequence
  sequence targeting B2M
caagccagcgacgcagtgcc

SEQ ID NO: 968 - DNA, 20 bp, Artificial Sequence
  sequence targeting B2M
cgcagtgccaggttagagag

SEQ ID NO: 969 - DNA, 20 bp, Artificial Sequence
  sequence targeting B2M
gcagtgccaggttagagaga

SEQ ID NO: 970 - DNA, 20 bp, Artificial Sequence
  sequence targeting B2M
gagtctcgtgatgtttaaga

SEQ ID NO: 971 - DNA, 20 bp, Artificial Sequence
  sequence targeting B2M
taagaaggcatgcactagac

SEQ ID NO: 972 - DNA, 20 bp, Artificial Sequence
  sequence targeting B2M
aagaaggcatgcactagact

SEQ ID NO: 973 - DNA, 20 bp, Artificial Sequence
  sequence targeting B2M
tgagtttgctgtctgtacat

SEQ ID NO: 974 - DNA, 20 bp, Artificial Sequence
  sequence targeting B2M
tacatcggcgccctccgatc

SEQ ID NO: 975 - DNA, 20 bp, Artificial Sequence
  sequence targeting B2M
acatcggcgccctccgatct

SEQ ID NO: 976 - DNA, 20 bp, Artificial Sequence
  sequence targeting B2M
catcggcgccctccgatctg

SEQ ID NO: 977 - DNA, 20 bp, Artificial Sequence
  sequence targeting B2M
ctggggtgcgcgccccagct

SEQ ID NO: 978 - DNA, 20 bp, Artificial Sequence
  sequence targeting B2M
tggggtgcgcgccccagctt

SEQ ID NO: 979 - DNA, 20 bp, Artificial Sequence
  sequence targeting B2M
cgcgccccagcttgggacac

SEQ ID NO: 980 - DNA, 20 bp, Artificial Sequence
  sequence targeting B2M
gcgccccagcttgggacacc

SEQ ID NO: 981 - DNA, 20 bp, Artificial Sequence
  sequence targeting B2M
caagtcacttagcatctctg

SEQ ID NO: 982 - DNA, 20 bp, Artificial Sequence
  sequence targeting B2M
acagaagttctccttctgct

SEQ ID NO: 983 - DNA, 20 bp, Artificial Sequence
  sequence targeting B2M
attcaaagatcttaatcttc

SEQ ID NO: 984 - DNA, 20 bp, Artificial Sequence
  sequence targeting B2M
ttcaaagatcttaatcttct

SEQ ID NO: 985 - DNA, 20 bp, Artificial Sequence
  sequence targeting B2M
ttttctcgaatgaaaaatgc

SEQ ID NO: 986 - DNA, 20 bp, Artificial Sequence
  sequence targeting B2M
tgcaggtccgagcagttaac

SEQ ID NO: 987 - DNA, 20 bp, Artificial Sequence
  sequence targeting B2M
ggtccgagcagttaactggc

SEQ ID NO: 988 - DNA, 20 bp, Artificial Sequence
  sequence targeting B2M
gtccgagcagttaactggct

SEQ ID NO: 989 - DNA, 20 bp, Artificial Sequence
  sequence targeting B2M
tccgagcagttaactggctg

SEQ ID NO: 990 - DNA, 20 bp, Artificial Sequence
  sequence targeting B2M
agcaagtcacttagcatctc

SEQ ID NO: 991 - DNA, 20 bp, Artificial Sequence
  sequence targeting B2M
gcaagtcacttagcatctct

SEQ ID NO: 992 - DNA, 20 bp, Artificial Sequence
  sequence targeting B2M
tggggccagtctgcaaagcg

SEQ ID NO: 993 - DNA, 20 bp, Artificial Sequence
  sequence targeting B2M
ggggccagtctgcaaagcga

SEQ ID NO: 994 - DNA, 20 bp, Artificial Sequence
  sequence targeting B2M
gggccagtctgcaaagcgag

SEQ ID NO: 995 - DNA, 20 bp, Artificial Sequence
  sequence targeting B2M
ggccagtctgcaaagcgagg

SEQ ID NO: 996 - DNA, 20 bp, Artificial Sequence
  sequence targeting B2M
ggacaccgggcgctcattct

SEQ ID NO: 997 - DNA, 20 bp, Artificial Sequence
  sequence targeting B2M
ggcgctcattctaggacttc

SEQ ID NO: 998 - DNA, 20 bp, Artificial Sequence
  sequence targeting B2M
ctcattctaggacttcaggc

SEQ ID NO: 999 - DNA, 20 bp, Artificial Sequence
  sequence targeting B2M
attctaggacttcaggctgg

SEQ ID NO: 1000 - DNA, 20 bp, Artificial Sequence
  sequence targeting B2M
ttcaggctggaggcacatta

SEQ ID NO: 1001 - DNA, 20 bp, Artificial Sequence
  sequence targeting B2M
tgccccctcgctttgcagac

SEQ ID NO: 1002 - DNA, 20 bp, Artificial Sequence
  sequence targeting B2M
gatgctaagtgacttgctaa

SEQ ID NO: 1003 - DNA, 20 bp, Artificial Sequence
  sequence targeting B2M
gccccagccagttaactgct

SEQ ID NO: 1004 - DNA, 20 bp, Artificial Sequence
  sequence targeting B2M
gcatttttcattcgagaaaa

SEQ ID NO: 1005 - DNA, 20 bp, Artificial Sequence
  sequence targeting B2M
tttgaatgctacctagcaga

SEQ ID NO: 1006 - DNA, 20 bp, Artificial Sequence
  sequence targeting B2M
ttctgtttataactacagct

SEQ ID NO: 1007 - DNA, 20 bp, Artificial Sequence
  sequence targeting B2M
tctgtttataactacagctt

SEQ ID NO: 1008 - DNA, 21 bp, Artificial Sequence
  target B2M sequence complement
agagaatggaaagtcaaattt

SEQ ID NO: 1009 - DNA, 21 bp, Artificial Sequence
  target B2M sequence complement
atggacatgatcttctttata

SEQ ID NO: 1010 - DNA, 21 bp, Artificial Sequence
  target B2M sequence complement
tggacatgatcttctttataa

SEQ ID NO: 1011 - DNA, 21 bp, Artificial Sequence
  target B2M sequence complement
ggacatgatcttctttataat

SEQ ID NO: 1012 - DNA, 21 bp, Artificial Sequence
  target B2M sequence complement
tgacaggattattggaaattt

SEQ ID NO: 1013 - DNA, 21 bp, Artificial Sequence
  target B2M sequence complement
ttgtggttaatctggtttatt

SEQ ID NO: 1014 - DNA, 21 bp, Artificial Sequence
  target B2M sequence complement
tgtggttaatctggtttattt

SEQ ID NO: 1015 - DNA, 21 bp, Artificial Sequence
  target B2M sequence complement
gcagagaatggaaagtcaaat

SEQ ID NO: 1016 - DNA, 21 bp, Artificial Sequence
  target B2M sequence complement
cagagaatggaaagtcaaatt

SEQ ID NO: 1017 - DNA, 21 bp, Artificial Sequence
  target B2M sequence complement
gagaatggaaagtcaaatttc

SEQ ID NO: 1018 - DNA, 21 bp, Artificial Sequence
  target B2M sequence complement
gtcacagcccaagatagttaa

SEQ ID NO: 1019 - DNA, 21 bp, Artificial Sequence
  target B2M sequence complement
tgcttatacacttacacttta

SEQ ID NO: 1020 - DNA, 21 bp, Artificial Sequence
  target B2M sequence complement
gcttatacacttacactttat

SEQ ID NO: 1021 - DNA, 21 bp, Artificial Sequence
  target B2M sequence complement
cttatacacttacactttatg

SEQ ID NO: 1022 - DNA, 21 bp, Artificial Sequence
  target B2M sequence complement
acatggacatgatcttcttta

SEQ ID NO: 1023 - DNA, 21 bp, Artificial Sequence
  target B2M sequence complement
catggacatgatcttctttat

SEQ ID NO: 1024 - DNA, 21 bp, Artificial Sequence
  target B2M sequence complement
atcaacatcttggtcagattt

SEQ ID NO: 1025 - DNA, 21 bp, Artificial Sequence
  target B2M sequence complement
cttgcactcaaagcttgttaa

SEQ ID NO: 1026 - DNA, 21 bp, Artificial Sequence
  target B2M sequence complement
agttaagcgtgcataagttaa

SEQ ID NO: 1027 - DNA, 21 bp, Artificial Sequence
  target B2M sequence complement
gcataagttaacttccaattt

SEQ ID NO: 1028 - DNA, 21 bp, Artificial Sequence
  target B2M sequence complement
tacatactctgcttagaattt

SEQ ID NO: 1029 - DNA, 21 bp, Artificial Sequence
  target B2M sequence complement
acatactctgcttagaatttg

SEQ ID NO: 1030 - DNA, 21 bp, Artificial Sequence
  target B2M sequence complement
ttgacaggattattggaaatt

SEQ ID NO: 1031 - DNA, 21 bp, Artificial Sequence
  target B2M sequence complement
gacaggattattggaaatttg

SEQ ID NO: 1032 - DNA, 21 bp, Artificial Sequence
  target B2M sequence complement
taaggcatggttgtggttaat

SEQ ID NO: 1033 - DNA, 21 bp, Artificial Sequence
  target B2M sequence complement
gttgtggttaatctggtttat

SEQ ID NO: 1034 - DNA, 21 bp, Artificial Sequence
  target B2M sequence complement
gttccacaagttaaataaatc

SEQ ID NO: 1035 - DNA, 21 bp, Artificial Sequence
  target B2M sequence complement
tccagcgtactccaaagattc

SEQ ID NO: 1036 - DNA, 21 bp, Artificial Sequence
  target B2M sequence complement
tactccaaagattcaggttta

SEQ ID NO: 1037 - DNA, 21 bp, Artificial Sequence
  target B2M sequence complement
actccaaagattcaggtttac

SEQ ID NO: 1038 - DNA, 21 bp, Artificial Sequence
  target B2M sequence complement
cacgtcatccagcagagaatg

SEQ ID NO: 1039 - DNA, 21 bp, Artificial Sequence
  target B2M sequence complement
ggtttcatccatccgacattg

SEQ ID NO: 1040 - DNA, 21 bp, Artificial Sequence
  target B2M sequence complement
ccgacattgaagttgacttac

SEQ ID NO: 1041 - DNA, 21 bp, Artificial Sequence
  target B2M sequence complement
tgaagaatggagagagaattg

SEQ ID NO: 1042 - DNA, 21 bp, Artificial Sequence
  target B2M sequence complement
gagcattcagacttgtctttc

SEQ ID NO: 1043 - DNA, 21 bp, Artificial Sequence
  target B2M sequence complement
ttcagcaaggactggtctttc

SEQ ID NO: 1044 - DNA, 21 bp, Artificial Sequence
  target B2M sequence complement
gcaaggactggtctttctatc

SEQ ID NO: 1045 - DNA, 21 bp, Artificial Sequence
  target B2M sequence complement
cgtgtgaaccatgtgactttg

SEQ ID NO: 1046 - DNA, 21 bp, Artificial Sequence
  target B2M sequence complement
ctttgtcacagcccaagatag

SEQ ID NO: 1047 - DNA, 21 bp, Artificial Sequence
  target B2M sequence complement
tcacagcccaagatagttaag

SEQ ID NO: 1048 - DNA, 21 bp, Artificial Sequence
  target B2M sequence complement
agtgggatcgagacatgtaag

SEQ ID NO: 1049 - DNA, 21 bp, Artificial Sequence
  target B2M sequence complement
aggtttgaagatgccgcattt

SEQ ID NO: 1050 - DNA, 21 bp, Artificial Sequence
  target B2M sequence complement
ggtttgaagatgccgcatttg

SEQ ID NO: 1051 - DNA, 21 bp, Artificial Sequence
  target B2M sequence complement
ttgatatgcttatacacttac

SEQ ID NO: 1052 - DNA, 21 bp, Artificial Sequence
  target B2M sequence complement
tgagtgctgtctccatgtttg

SEQ ID NO: 1053 - DNA, 21 bp, Artificial Sequence
  target B2M sequence complement
tgtctccatgtttgatgtatc

SEQ ID NO: 1054 - DNA, 21 bp, Artificial Sequence
  target B2M sequence complement
tcaacatcttggtcagatttg

SEQ ID NO: 1055 - DNA, 21 bp, Artificial Sequence
  target B2M sequence complement
tcagatttgaactcttcaatc

SEQ ID NO: 1056 - DNA, 21 bp, Artificial Sequence
  target B2M sequence complement
ttcaatctcttgcactcaaag

SEQ ID NO: 1057 - DNA, 21 bp, Artificial Sequence
  target B2M sequence complement
ttgcactcaaagcttgttaag

SEQ ID NO: 1058 - DNA, 21 bp, Artificial Sequence
  target B2M sequence complement
actcaaagcttgttaagatag

SEQ ID NO: 1059 - DNA, 21 bp, Artificial Sequence
  target B2M sequence complement
agatagttaagcgtgcataag

SEQ ID NO: 1060 - DNA, 21 bp, Artificial Sequence
  target B2M sequence complement
tgcataagttaacttccaatt

SEQ ID NO: 1061 - DNA, 21 bp, Artificial Sequence
  target B2M sequence complement
gttaacttccaatttacatac

SEQ ID NO: 1062 - DNA, 21 bp, Artificial Sequence
  target B2M sequence complement
attgacaggattattggaaat

SEQ ID NO: 1063 - DNA, 21 bp, Artificial Sequence
  target B2M sequence complement
gtaaggcatggttgtggttaa

SEQ ID NO: 1064 - DNA, 21 bp, Artificial Sequence
  target B2M sequence complement
ggttgtggttaatctggttta

SEQ ID NO: 1065 - DNA, 21 bp, Artificial Sequence
  target B2M sequence complement
ttcctgaagctgacagcattc

SEQ ID NO: 1066 - DNA, 21 bp, Artificial Sequence
  target B2M sequence complement
gctatccagcgtactccaaag

SEQ ID NO: 1067 - DNA, 21 bp, Artificial Sequence
  target B2M sequence complement
catccagcagagaatggaaag

SEQ ID NO: 1068 - DNA, 21 bp, Artificial Sequence
  target B2M sequence complement
caaatttcctgaattgctatg

SEQ ID NO: 1069 - DNA, 21 bp, Artificial Sequence
  target B2M sequence complement
attgctatgtgtctgggtttc

SEQ ID NO: 1070 - DNA, 21 bp, Artificial Sequence
  target B2M sequence complement
gaagatgccgcatttggattg

SEQ ID NO: 1071 - DNA, 21 bp, Artificial Sequence
  target B2M sequence complement
caatttacatactctgcttag

SEQ ID NO: 1072 - DNA, 21 bp, Artificial Sequence
  target B2M sequence complement
tatccagcgtactccaaagat

SEQ ID NO: 1073 - DNA, 21 bp, Artificial Sequence
  target B2M sequence complement
atccagcgtactccaaagatt

SEQ ID NO: 1074 - DNA, 21 bp, Artificial Sequence
  target B2M sequence complement
ctccaaagattcaggtttact

SEQ ID NO: 1075 - DNA, 21 bp, Artificial Sequence
  target B2M sequence complement
tgctatgtgtctgggtttcat

SEQ ID NO: 1076 - DNA, 21 bp, Artificial Sequence
  target B2M sequence complement
tttcatccatccgacattgaa

SEQ ID NO: 1077 - DNA, 21 bp, Artificial Sequence
  target B2M sequence complement
gaagttgacttactgaagaat

SEQ ID NO: 1078 - DNA, 21 bp, Artificial Sequence
  target B2M sequence complement
gaagaatggagagagaattga

SEQ ID NO: 1079 - DNA, 21 bp, Artificial Sequence
  target B2M sequence complement
agaatggagagagaattgaaa

SEQ ID NO: 1080 - DNA, 21 bp, Artificial Sequence
  target B2M sequence complement
cagcaaggactggtctttcta

SEQ ID NO: 1081 - DNA, 21 bp, Artificial Sequence
  target B2M sequence complement
agcaaggactggtctttctat

SEQ ID NO: 1082 - DNA, 21 bp, Artificial Sequence
  target B2M sequence complement
actttgtcacagcccaagata

SEQ ID NO: 1083 - DNA, 21 bp, Artificial Sequence
  target B2M sequence complement
ttgtcacagcccaagatagtt

SEQ ID NO: 1084 - DNA, 21 bp, Artificial Sequence
  target B2M sequence complement
tgtcacagcccaagatagtta

SEQ ID NO: 1085 - DNA, 21 bp, Artificial Sequence
  target B2M sequence complement
cacagcccaagatagttaagt

SEQ ID NO: 1086 - DNA, 21 bp, Artificial Sequence
  target B2M sequence complement
gcagcatcatggaggtttgaa

SEQ ID NO: 1087 - DNA, 21 bp, Artificial Sequence
  target B2M sequence complement
ccgcatttggattggatgaat

SEQ ID NO: 1088 - DNA, 21 bp, Artificial Sequence
  target B2M sequence complement
ttgagtgctgtctccatgttt

SEQ ID NO: 1089 - DNA, 21 bp, Artificial Sequence
  target B2M sequence complement
agtgctgtctccatgtttgat

SEQ ID NO: 1090 - DNA, 21 bp, Artificial Sequence
  target B2M sequence complement
ctgtctccatgtttgatgtat

SEQ ID NO: 1091 - DNA, 21 bp, Artificial Sequence
  target B2M sequence complement
tctaggagggctggcaactta

SEQ ID NO: 1092 - DNA, 21 bp, Artificial Sequence
  target B2M sequence complement
caacatcttggtcagatttga

SEQ ID NO: 1093 - DNA, 21 bp, Artificial Sequence
  target B2M sequence complement
gtcagatttgaactcttcaat

SEQ ID NO: 1094 - DNA, 21 bp, Artificial Sequence
  target B2M sequence complement
tcttgcactcaaagcttgtta

SEQ ID NO: 1095 - DNA, 21 bp, Artificial Sequence
  target B2M sequence complement
tgcactcaaagcttgttaaga

SEQ ID NO: 1096 - DNA, 21 bp, Artificial Sequence
  target B2M sequence complement
gcactcaaagcttgttaagat

SEQ ID NO: 1097 - DNA, 21 bp, Artificial Sequence
  target B2M sequence complement
cactcaaagcttgttaagata

SEQ ID NO: 1098 - DNA, 21 bp, Artificial Sequence
  target B2M sequence complement
tcaaagcttgttaagatagtt

SEQ ID NO: 1099 - DNA, 21 bp, Artificial Sequence
  target B2M sequence complement
caaagcttgttaagatagtta

SEQ ID NO: 1100 - DNA, 21 bp, Artificial Sequence
  target B2M sequence complement
gatagttaagcgtgcataagt

SEQ ID NO: 1101 - DNA, 21 bp, Artificial Sequence
  target B2M sequence complement
atagttaagcgtgcataagtt

SEQ ID NO: 1102 - DNA, 21 bp, Artificial Sequence
  target B2M sequence complement
tagttaagcgtgcataagtta

SEQ ID NO: 1103 - DNA, 21 bp, Artificial Sequence
  target B2M sequence complement
ttaagcgtgcataagttaact

SEQ ID NO: 1104 - DNA, 21 bp, Artificial Sequence
  target B2M sequence complement
taagcgtgcataagttaactt

SEQ ID NO: 1105 - DNA, 21 bp, Artificial Sequence
  target B2M sequence complement
atttacatactctgcttagaa

SEQ ID NO: 1106 - DNA, 21 bp, Artificial Sequence
  target B2M sequence complement
tttacatactctgcttagaat

SEQ ID NO: 1107 - DNA, 21 bp, Artificial Sequence
  target B2M sequence complement
acaggattattggaaatttgt

SEQ ID NO: 1108 - DNA, 21 bp, Artificial Sequence
  target B2M sequence complement
caggattattggaaatttgtt

SEQ ID NO: 1109 - DNA, 21 bp, Artificial Sequence
  target B2M sequence complement
aggcatggttgtggttaatct

SEQ ID NO: 1110 - DNA, 21 bp, Artificial Sequence
  target B2M sequence complement
cagcagagaatggaaagtcaa

SEQ ID NO: 1111 - DNA, 21 bp, Artificial Sequence
  target B2M sequence complement
tccgacattgaagttgactta

SEQ ID NO: 1112 - DNA, 21 bp, Artificial Sequence
  target B2M sequence complement
ctggtctttctatctcttgta

SEQ ID NO: 1113 - DNA, 21 bp, Artificial Sequence
  target B2M sequence complement
ccgtgtgaaccatgtgacttt

SEQ ID NO: 1114 - DNA, 21 bp, Artificial Sequence
  target B2M sequence complement
cccaagatagttaagtgggat

SEQ ID NO: 1115 - DNA, 21 bp, Artificial Sequence
  target B2M sequence complement
ggttgctccacaggtagctct

SEQ ID NO: 1116 - DNA, 21 bp, Artificial Sequence
  target B2M sequence complement
gctccacaggtagctctagga

SEQ ID NO: 1117 - DNA, 21 bp, Artificial Sequence
  target B2M sequence complement
gggagcagagaattctcttat

SEQ ID NO: 1118 - DNA, 21 bp, Artificial Sequence
  target B2M sequence complement
ggagcagagaattctcttatc

SEQ ID NO: 1119 - DNA, 21 bp, Artificial Sequence
  target B2M sequence complement
gagcagagaattctcttatcc

SEQ ID NO: 1120 - DNA, 21 bp, Artificial Sequence
  target B2M sequence complement
gagaattctcttatccaacat

SEQ ID NO: 1121 - DNA, 21 bp, Artificial Sequence
  target B2M sequence complement
gaattctcttatccaacatca

SEQ ID NO: 1122 - DNA, 21 bp, Artificial Sequence
  target B2M sequence complement
aagtggagcattcagacttgt

SEQ ID NO: 1123 - DNA, 21 bp, Artificial Sequence
  target B2M sequence complement
aaggactggtctttctatctc

SEQ ID NO: 1124 - DNA, 21 bp, Artificial Sequence
  target B2M sequence complement
aagcttgttaagatagttaag

SEQ ID NO: 1125 - DNA, 21 bp, Artificial Sequence
  target B2M sequence complement
aagcgtgcataagttaacttc

SEQ ID NO: 1126 - DNA, 21 bp, Artificial Sequence
  target B2M sequence complement
aagatgccgcatttggattgg

SEQ ID NO: 1127 - DNA, 21 bp, Artificial Sequence
  target B2M sequence complement
aagaatggagagagaattgaa

SEQ ID NO: 1128 - DNA, 21 bp, Artificial Sequence
  target B2M sequence complement
aacatcaacatcttggtcaga

SEQ ID NO: 1129 - DNA, 21 bp, Artificial Sequence
  target B2M sequence complement
aaggcatggttgtggttaatc

SEQ ID NO: 1130 - DNA, 21 bp, Artificial Sequence
  target B2M sequence complement
aagcagcatcatggaggtttg

SEQ ID NO: 1131 - DNA, 21 bp, Artificial Sequence
  target B2M sequence complement
aagatgagtatgcctgccgtg

SEQ ID NO: 1132 - DNA, 21 bp, Artificial Sequence
  target B2M sequence complement
aagttgacttactgaagaatg

SEQ ID NO: 1133 - DNA, 21 bp, Artificial Sequence
  target B2M sequence complement
aagatagttaagcgtgcataa

SEQ ID NO: 1134 - DNA, 21 bp, Artificial Sequence
  target B2M sequence complement
aacttccaatttacatactct

SEQ ID NO: 1135 - DNA, 21 bp, Artificial Sequence
  target B2M sequence complement
aacatcttggtcagatttgaa

SEQ ID NO: 1136 - DNA, 21 bp, Artificial Sequence
  target B2M sequence complement
aactcttcaatctcttgcact

SEQ ID NO: 1137 - DNA, 21 bp, Artificial Sequence
  target B2M sequence complement
aatttcctgaattgctatgtg

SEQ ID NO: 1138 - DNA, 21 bp, Artificial Sequence
  target B2M sequence complement
aatggaaagtcaaatttcctg

SEQ ID NO: 1139 - DNA, 21 bp, Artificial Sequence
  target B2M sequence complement
aaccatgtgactttgtcacag

SEQ ID NO: 1140 - DNA, 21 bp, Artificial Sequence
  target B2M sequence complement
aattgacaggattattggaaa

SEQ ID NO: 1141 - DNA, 21 bp, Artificial Sequence
  target B2M sequence complement
aattctcttatccaacatcaa

SEQ ID NO: 1142 - DNA, 21 bp, Artificial Sequence
  target B2M sequence complement
aaagtggagcattcagacttg

SEQ ID NO: 1143 - DNA, 21 bp, Artificial Sequence
  target B2M sequence complement
aaagtcaaatttcctgaattg

SEQ ID NO: 1144 - DNA, 21 bp, Artificial Sequence
  target B2M sequence complement
gttgctccacaggtagctcta

SEQ ID NO: 1145 - DNA, 21 bp, Artificial Sequence
  target B2M sequence complement
aatttacatactctgcttaga

SEQ ID NO: 1146 - DNA, 21 bp, Artificial Sequence
  target HLA sequence complement
cttcttccttccctattaaaa

SEQ ID NO: 1147 - DNA, 21 bp, Artificial Sequence
  target HLA sequence complement
tctcactccatgaggtatttc

SEQ ID NO: 1148 - DNA, 21 bp, Artificial Sequence
  target HLA sequence complement
ctctcactccatgaggtattt

SEQ ID NO: 1149 - DNA, 21 bp, Artificial Sequence
  target HLA sequence complement
gaggaggaagagctcagatag

SEQ ID NO: 1150 - DNA, 21 bp, Artificial Sequence
  target HLA sequence complement
gctctcactccatgaggtatt

SEQ ID NO: 1151 - DNA, 21 bp, Artificial Sequence
  target HLA sequence complement
aggattacatcgccctgaaag

SEQ ID NO: 1152 - DNA, 21 bp, Artificial Sequence
  target HLA sequence complement
acaccgtccagaggatgtatg

SEQ ID NO: 1153 - DNA, 21 bp, Artificial Sequence
  target HLA sequence complement
agggtccttcttcctggatac

SEQ ID NO: 1154 - DNA, 21 bp, Artificial Sequence
  target HLA sequence complement
cctacgacggcaaggattaca

SEQ ID NO: 1155 - DNA, 21 bp, Artificial Sequence
  target HLA sequence complement
tcactccatgaggtatttctt

SEQ ID NO: 1156 - DNA, 21 bp, Artificial Sequence
  target HLA sequence complement
ctacgacggcaaggattacat

SEQ ID NO: 1157 - DNA, 21 bp, Artificial Sequence
  target HLA sequence complement
ctcactccatgaggtatttct

SEQ ID NO: 1158 - DNA, 21 bp, Artificial Sequence
  target HLA sequence complement
ggaggaagagctcagatagaa

SEQ ID NO: 1159 - DNA, 21 bp, Artificial Sequence
  target HLA sequence complement
cacaccgtccagaggatgtat

SEQ ID NO: 1160 - DNA, 21 bp, Artificial Sequence
  target HLA sequence complement
cacgctgtctctgaccatgaa

SEQ ID NO: 1161 - DNA, 21 bp, Artificial Sequence
  target HLA sequence complement
ctggacaggagcagagataca

SEQ ID NO: 1162 - DNA, 21 bp, Artificial Sequence
  target HLA sequence complement
tggaggaggaagagctcagat

SEQ ID NO: 1163 - DNA, 21 bp, Artificial Sequence
  target HLA sequence complement
ggctctcactccatgaggtat

SEQ ID NO: 1164 - DNA, 21 bp, Artificial Sequence
  target HLA sequence complement
catctctgtctcaacttcatg

SEQ ID NO: 1165 - DNA, 21 bp, Artificial Sequence
  target HLA sequence complement
tacgacggcaaggattacatc

SEQ ID NO: 1166 - DNA, 21 bp, Artificial Sequence
  target HLA sequence complement
ggattacatcgccctgaaaga

SEQ ID NO: 1167 - DNA, 21 bp, Artificial Sequence
  target HLA sequence complement
gattacatcgccctgaaagag

SEQ ID NO: 1168 - DNA, 21 bp, Artificial Sequence
  target HLA sequence complement
ctcagaccaccaagcacaagt

SEQ ID NO: 1169 - DNA, 21 bp, Artificial Sequence
  target HLA sequence complement
tcacaccgtccagaggatgta

SEQ ID NO: 1170 - DNA, 21 bp, Artificial Sequence
  target HLA sequence complement
actccatgaggtatttcttca

SEQ ID NO: 1171 - DNA, 21 bp, Artificial Sequence
  target HLA sequence complement
cactccatgaggtatttcttc

SEQ ID NO: 1172 - DNA, 21 bp, Artificial Sequence
  target HLA sequence complement
ccatgaggtatttcttcacat

SEQ ID NO: 1173 - DNA, 21 bp, Artificial Sequence
  target HLA sequence complement
acttcttccttccctattaaa

SEQ ID NO: 1174 - DNA, 21 bp, Artificial Sequence
  target HLA sequence complement
gtgtctctcacagcttgtaaa

SEQ ID NO: 1175 - DNA, 21 bp, Artificial Sequence
  target HLA sequence complement
ctgtgttcgtgtaggcataat

SEQ ID NO: 1176 - DNA, 21 bp, Artificial Sequence
  target HLA sequence complement
tgtgttcgtgtaggcataatg

SEQ ID NO: 1177 - DNA, 21 bp, Artificial Sequence
  target HLA sequence complement
taacttcttccttccctatta

SEQ ID NO: 1178 - DNA, 21 bp, Artificial Sequence
  target HLA sequence complement
tctggacaggagcagagatac

SEQ ID NO: 1179 - DNA, 21 bp, Artificial Sequence
  target HLA sequence complement
ttgctggcctggttctctttg

SEQ ID NO: 1180 - DNA, 21 bp, Artificial Sequence
  target HLA sequence complement
tgtctctcacagcttgtaaag

SEQ ID NO: 1181 - DNA, 21 bp, Artificial Sequence
  target HLA sequence complement
acttgaagaaccctgactttg

SEQ ID NO: 1182 - DNA, 21 bp, Artificial Sequence
  target HLA sequence complement
gaagaaccctgactttgtttc

SEQ ID NO: 1183 - DNA, 21 bp, Artificial Sequence
  target HLA sequence complement
tctgtgttcgtgtaggcataa

SEQ ID NO: 1184 - DNA, 21 bp, Artificial Sequence
  target HLA sequence complement
catggtgcactgagctgtaac

SEQ ID NO: 1185 - DNA, 21 bp, Artificial Sequence
  target HLA sequence complement
gtaacttcttccttccctatt

SEQ ID NO: 1186 - DNA, 21 bp, Artificial Sequence
  target HLA sequence complement
catgtgcagcatgagggtttg

SEQ ID NO: 1187 - DNA, 21 bp, Artificial Sequence
  target HLA sequence complement
ttgttcctgcccttccctttg

SEQ ID NO: 1188 - DNA, 21 bp, Artificial Sequence
  target HLA sequence complement
acccagttctcactcccattg

SEQ ID NO: 1189 - DNA, 21 bp, Artificial Sequence
  target HLA sequence complement
gggtttccagagaagccaatc

SEQ ID NO: 1190 - DNA, 21 bp, Artificial Sequence
  target HLA sequence complement
ttctccctctcccaacctatg

SEQ ID NO: 1191 - DNA, 21 bp, Artificial Sequence
  target HLA sequence complement
gtctctcacagcttgtaaagt

SEQ ID NO: 1192 - DNA, 21 bp, Artificial Sequence
  target HLA sequence complement
tgtgtctctcacagcttgtaa

SEQ ID NO: 1193 - DNA, 21 bp, Artificial Sequence
  target HLA sequence complement
gaggaagagctcagatagaaa

SEQ ID NO: 1194 - DNA, 21 bp, Artificial Sequence
  target HLA sequence complement
tgaagaaccctgactttgttt

SEQ ID NO: 1195 - DNA, 21 bp, Artificial Sequence
  target HLA sequence complement
ttgaagaaccctgactttgtt

SEQ ID NO: 1196 - DNA, 21 bp, Artificial Sequence
  target HLA sequence complement
gtgttcgtgtaggcataatgt

SEQ ID NO: 1197 - DNA, 21 bp, Artificial Sequence
  target HLA sequence complement
tggtgcactgagctgtaactt

SEQ ID NO: 1198 - DNA, 21 bp, Artificial Sequence
  target HLA sequence complement
ctccctctcccaacctatgta

SEQ ID NO: 1199 - DNA, 21 bp, Artificial Sequence
  target HLA sequence complement
aggaggaagagctcagataga

SEQ ID NO: 1200 - DNA, 21 bp, Artificial Sequence
  target HLA sequence complement
acctatgtagggtccttcttc

SEQ ID NO: 1201 - DNA, 21 bp, Artificial Sequence
  target HLA sequence complement
gggtccttcttcctggatact

SEQ ID NO: 1202 - DNA, 21 bp, Artificial Sequence
  target HLA sequence complement
ggtccttcttcctggatactc

SEQ ID NO: 1203 - DNA, 21 bp, Artificial Sequence
  target HLA sequence complement
gtccttcttcctggatactca

SEQ ID NO: 1204 - DNA, 21 bp, Artificial Sequence
  target HLA sequence complement
aagccaatcagtgtcgtcgcg

SEQ ID NO: 1205 - DNA, 21 bp, Artificial Sequence
  target HLA sequence complement
aagaggacctgcgctcttgga

SEQ ID NO: 1206 - DNA, 21 bp, Artificial Sequence
  target HLA sequence complement
aagtgtgagacagctgccttg

SEQ ID NO: 1207 - DNA, 21 bp, Artificial Sequence
  target HLA sequence complement
aaggcacctgcatgtgtctgt

SEQ ID NO: 1208 - DNA, 21 bp, Artificial Sequence
  target HLA sequence complement
aatcatctttcctgttccaga

SEQ ID NO: 1209 - DNA, 21 bp, Artificial Sequence
  target HLA sequence complement
aaaggcacctgcatgtgtctg

SEQ ID NO: 1210 - DNA, 21 bp, Artificial Sequence
  target HLA sequence complement
aaagaggacctgcgctcttgg

SEQ ID NO: 1211 - DNA, 21 bp, Artificial Sequence
  target HLA sequence complement
aaacgcatatgactcaccacg

SEQ ID NO: 1212 - DNA, 19 bp, Artificial Sequence
  target HLA sequence complement
ggaagagctcagatagaaa

SEQ ID NO: 1213 - DNA, 19 bp, Artificial Sequence
  target HLA sequence complement
gggagacacggaaagtgaa

SEQ ID NO: 1214 - DNA, 21 bp, Artificial Sequence
  target HLA sequence complement
cacctgccatgtgcagcatga

SEQ ID NO: 1215 - DNA, 21 bp, Artificial Sequence
  target HLA sequence complement
ggagatcacactgacctggca

SEQ ID NO: 1216 - DNA, 20 bp, Artificial Sequence
  target HLA sequence complement
ggattacatcgccctgaaag

SEQ ID NO: 1217 - DNA, 20 bp, Artificial Sequence
  target HLA sequence complement
gcaggagggtccggagtatt

SEQ ID NO: 1218 - DNA, 20 bp, Artificial Sequence
  target HLA sequence complement
ggacggggagacacggaaag

SEQ ID NO: 1219 - DNA, 19 bp, Artificial Sequence
  target HLA sequence complement
gaaagtgaaggcccactca

SEQ ID NO: 1220 - DNA, 20 bp, Artificial Sequence
  target HLA sequence complement
gatacctggagaacgggaag

SEQ ID NO: 1221 - DNA, 20 bp, Artificial Sequence
  target HLA sequence complement
gctgtggtggtgccttctgg

SEQ ID NO: 1222 - DNA, 20 bp, Artificial Sequence
  target HLA sequence complement
gctactacaaccagagcgag

SEQ ID NO: 1223 - DNA, 19 bp, Artificial Sequence
  target HLA sequence complement
gtggctccgcagatacctg

SEQ ID NO: 1224 - DNA, 19 bp, Artificial Sequence
  target HLA sequence complement
gccaatcagtgtcgtcgcg

SEQ ID NO: 1225 - DNA, 19 bp, Artificial Sequence
  target HLA sequence complement
gaggacctgcgctcttgga

SEQ ID NO: 1226 - DNA, 19 bp, Artificial Sequence
  target HLA sequence complement
gtgtgagacagctgccttg

SEQ ID NO: 1227 - DNA, 19 bp, Artificial Sequence
  target HLA sequence complement
ggcacctgcatgtgtctgt

SEQ ID NO: 1228 - DNA, 19 bp, Artificial Sequence
  target HLA sequence complement
tcatctttcctgttccaga

SEQ ID NO: 1229 - DNA, 19 bp, Artificial Sequence
  target HLA sequence complement
aggcacctgcatgtgtctg

SEQ ID NO: 1230 - DNA, 19 bp, Artificial Sequence
  target HLA sequence complement
agaggacctgcgctcttgg

SEQ ID NO: 1231 - DNA, 19 bp, Artificial Sequence
  target HLA sequence complement
acgcatatgactcaccacg

SEQ ID NO: 1232 - RNA, 2 nt, Artificial Sequence
  5' Flank Sequence
gg

SEQ ID NO: 1233 - RNA, 23 nt, Artificial Sequence
  5' Flank Sequence
acaccauguugccagucucuagg

SEQ ID NO: 1234 - RNA, 23 nt, Artificial Sequence
  5' Flank Sequence
ugauagcaaugucagcagugccu

SEQ ID NO: 1235 - RNA, 23 nt, Artificial Sequence
  5' Flank Sequence
uauugcuguugacagugagcgac

SEQ ID NO: 1236 - RNA, 21 nt, Artificial Sequence
  3' Flank Sequence
uggcgucuggcccaaccacac

SEQ ID NO: 1237 - RNA, 21 nt, Artificial Sequence
  3' Flank Sequence
guaagguugaccauacucuac

SEQ ID NO: 1238 - RNA, 4 nt, Artificial Sequence
  Loop Region Sequence
cgaa

SEQ ID NO: 1239 - RNA, 7 nt, Artificial Sequence
  Loop Region Sequence
uucaaga

SEQ ID NO: 1240 - RNA, 7 nt, Artificial Sequence
  Loop Region Sequence
auauuca

SEQ ID NO: 1241 - RNA, 9 nt, Artificial Sequence
  Loop Region Sequence
ugugcuguc

SEQ ID NO: 1242 - RNA, 6 nt, Artificial Sequence
  Loop Region Sequence
cucgag

SEQ ID NO: 1243 - RNA, 12 nt, Artificial Sequence
  Loop Region Sequence
cuuccugucaga

SEQ ID NO: 1244 - RNA, 15 nt, Artificial Sequence
  Loop Region Sequence
cuucccuuugucaga

SEQ ID NO: 1245 - RNA, 12 nt, Artificial Sequence
  Loop Region Sequence
guguuauucuug

SEQ ID NO: 1246 - RNA, 12 nt, Artificial Sequence
  Loop Region Sequence
gugucuuaauug

SEQ ID NO: 1247 - RNA, 12 nt, Artificial Sequence
  Loop Region Sequence
guguuagucuug

SEQ ID NO: 1248 - RNA, 7 nt, Artificial Sequence
  Loop Region Sequence
ucaagag

SEQ ID NO: 1249 - RNA, 12 nt, Artificial Sequence
  Loop Region Sequence
ggacauccaggg

SEQ ID NO: 1250 - RNA, 15 nt, Artificial Sequence
  Loop Region Sequence
gugaagccacagaug

SEQ ID NO: 1251 - RNA, 10 nt, Artificial Sequence
  Loop Region Sequence
gauucuaaaa

SEQ ID NO: 1252 - DNA, 1443 bp, Artificial Sequence
  PA2.1.14 (VL:VH) scFv LIR1 sHTICD
gacattcaaatgacccagagcccatccaccctgagcgcatctgtaggtgaccgggtcaccatcacttgtagatccagtcagagtattgtacacagtaatgggaacacctatttggaatggtatcagcagaaaccaggtaaagccccaaaattgctcatctacaaagtctctaacagatttagtggtgtaccagccaggttcagcggttccggaagtggtactgaattcaccctcacgatctcctctctccagccagatgatttcgccacttattactgttttcaaggttcacatgtgccgcgcacattcggtcagggtactaaagtagaagtcaaaggcggaggtggaagcggagggggaggatctggcggcggaggaagcggaggccaggtgcagctggtgcagtctggggctgaggtgaagaagcctgggtcctcagtgaaggtttcctgcaaggcttctggatacaccttcactagctatcatatacattgggtgcgccaggcccccggacaagggcttgagtggatcggatggatctaccctggcaatgttaacacagaatataatgagaagttcaagggcaaagccaccattaccgcggacgaatccacgaacacagcctacatggagctgagcagcctgagatctgaagacacggctgtgtattactgtgcgagggaggaaattacctacgctatggactactggggccagggaaccctggtcaccgtgtcctcagtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactag

SEQ ID NO: 1253 - DNA, 1503 bp, Artificial Sequence
  PA2.1.14 (VL:VH) scFv LIR1 HTICD
gacattcaaatgacccagagcccatccaccctgagcgcatctgtaggtgaccgggtcaccatcacttgtagatccagtcagagtattgtacacagtaatgggaacacctatttggaatggtatcagcagaaaccaggtaaagccccaaaattgctcatctacaaagtctctaacagatttagtggtgtaccagccaggttcagcggttccggaagtggtactgaattcaccctcacgatctcctctctccagccagatgatttcgccacttattactgttttcaaggttcacatgtgccgcgcacattcggtcagggtactaaagtagaagtcaaaggcggaggtggaagcggagggggaggatctggcggcggaggaagcggaggccaggtgcagctggtgcagtctggggctgaggtgaagaagcctgggtcctcagtgaaggtttcctgcaaggcttctggatacaccttcactagctatcatatacattgggtgcgccaggcccccggacaagggcttgagtggatcggatggatctaccctggcaatgttaacacagaatataatgagaagttcaagggcaaagccaccattaccgcggacgaatccacgaacacagcctacatggagctgagcagcctgagatctgaagacacggctgtgtattactgtgcgagggaggaaattacctacgctatggactactggggccagggaaccctggtcaccgtgtcctcatacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactag

SEQ ID NO: 1254 - DNA, 1386 bp, Artificial Sequence
  MSLN_SsI CD8_HT 41BB CD3z
caagtccagctccagcagtcgggcccagagttggagaagcctggggcgagcgtgaagatctcatgcaaagcctcaggctactcctttactggatacacgatgaattgggtgaaacagtcgcatggaaagtcactggaatggatcggtctgattacgccctacaacggcgcctccagctacaaccagaagttcaggggaaaggcgacccttactgtcgacaagtcgtcaagcaccgcctacatggacctcctgtccctgacctccgaagatagcgcggtctacttttgtgcacgcggaggttacgatggacggggattcgactactggggccagggaaccactgtcaccgtgtcgagcggaggcggagggagcggaggaggaggcagcggaggtggagggtcggatatcgaactcactcagtccccagcaatcatgtccgcttcaccgggagaaaaggtgaccatgacttgctcggcctcctcgtccgtgtcatacatgcactggtaccaacaaaaatcggggacctcccctaagagatggatctacgataccagcaaactggcttcaggcgtgccgggacgcttctcgggttcggggagcggaaattcgtattcgttgaccatttcgtccgtggaagccgaggacgacgcaacttattactgccaacagtggtcaggctacccgctcactttcggagccggcactaagctggagatcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1255 - DNA, 1443 bp, Artificial Sequence
  PA2.1.14 scFv LIR1 sHTICD
caggtgcagctggtgcagtctggggctgaggtgaagaagcctgggtcctcagtgaaggtttcctgcaaggcttctggatacaccttcactagctatcatatacattgggtgcgccaggcccccggacaagggcttgagtggatcggatggatctaccctggcaatgttaacacagaatataatgagaagttcaagggcaaagccaccattaccgcggacgaatccacgaacacagcctacatggagctgagcagcctgagatctgaagacacggctgtgtattactgtgcgagggaggaaattacctacgctatggactactggggccagggaaccctggtcaccgtgtcctcaggcggaggtggaagcggagggggaggatctggcggcggaggaagcggaggcgacattcaaatgacccagagcccatccaccctgagcgcatctgtaggtgaccgggtcaccatcacttgtagatccagtcagagtattgtacacagtaatgggaacacctatttggaatggtatcagcagaaaccaggtaaagccccaaaattgctcatctacaaagtctctaacagatttagtggtgtaccagccaggttcagcggttccggaagtggtactgaattcaccctcacgatctcctctctccagccagatgatttcgccacttattactgttttcaaggttcacatgtgccgcgcacattcggtcagggtactaaagtagaagtcaaagtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactag

What is claimed is:
1. An immune cell comprising:
   (a) an activator receptor comprising an extracellular ligand binding domain specific to a Mesothelin (MSLN) antigen, wherein the extracellular ligand binding domain of the activator receptor comprises an scFv comprising
      (i) a heavy chain variable region (VH) comprising a complementarity determining region (CDR)-H1 of SEQ ID NO: 438, a CDR-H2 of SEQ ID NO: 454, and a CDR-H3 of SEQ ID NO: 533; and
      (ii) a variable light chain region (VL) comprising a CDR-L1 of SEQ ID NO: 535, a CDR-L2 of SEQ ID NO: 539, and a CDR-L3 of SEQ ID NO: 542; and
   (b) an inhibitory receptor specific to an HLA-A*02 antigen.
2. The immune cell of claim 1, wherein the scFv of the activator receptor comprises a sequence having at least 95% identity to the sequence of SEQ ID NO: 171.
3. The immune cell of claim 1, wherein the scFv of the activator receptor comprises the sequence of SEQ ID NO: 171.
4. The immune cell of claim 1, wherein the inhibitory receptor comprises an scFv comprising
   (i) a VH comprises a CDR-H1 of SEQ ID NO: 45, a CDR-H2 of SEQ ID NO: 46, and a CDR-H3 of SEQ ID NO: 47; and
   (ii) a VL comprising a CDR-L1 of SEQ ID NO: 42, a CDR-L2 of SEQ ID NO: 43, and a CDR-L3 of SEQ ID NO: 44.
5. The immune cell of claim 4, wherein the scFv of the inhibitory receptor comprises a sequence having at least 95% identity to the sequence of SEQ ID NO: 30.
6. The immune cell of claim 4, wherein the scFv of the inhibitory receptor comprises the sequence of SEQ ID NO: 30.
7. The immune cell of claim 1, wherein the immune cell is a T cell.
8. The immune cell of claim 1, wherein the activator receptor is a chimeric antigen receptor (CAR) comprising a hinge sequence isolated or derived from CD8, a transmembrane domain isolated or derived from CD8, and an intracellular domain isolated or derived from CD28, 4-1BB or CD3z, or a combination thereof.
9. The immune cell of claim 8, wherein the CAR comprises the sequence of SEQ ID NO: 303.
10. The immune cell of claim 1, wherein the inhibitory receptor comprises a CAR comprising a LILRB1 intracellular domain, a LILRB1 hinge domain, and a LILRB1 transmembrane domain.
11. The immune cell of claim 10, wherein the CAR comprises the sequence of SEQ ID NO: 348.
12. The immune cell of claim 1, wherein the immune cell is modified to inactivate, or reduce or eliminate expression or function of an endogenous gene encoding an allele of an endogenous MHC class I polypeptide.
13. The immune cell of claim 12, wherein the gene encoding the MHC class I polypeptide is HLA-A*02.
14. The immune cell of claim 1, wherein the immune cell is modified to reduce or eliminate expression of the B2M gene product.

15. A pharmaceutical composition, comprising a therapeutically effective amount of the immune cells of claim 1 and a pharmaceutically acceptable carrier, diluent or excipient.

16. A polynucleotide system comprising one or more polynucleotides comprising polynucleotide sequences encoding
  (a) an activator receptor comprising an extracellular ligand binding domain specific to a MSLN antigen, wherein the extracellular ligand binding domain of the activator receptor comprises an scFv comprising
    (i) a VH comprising a CDR-H1 of SEQ ID NO: 438, a CDR-H2 of SEQ ID NO: 454, and a CDR-H3 of SEQ ID NO: 533; and
    (ii) a VL comprising a CDR-L1 of SEQ ID NO: 535, a CDR-L2 of SEQ ID NO: 539, and a CDR-L3 of SEQ ID NO: 542;
  and
  (b) an inhibitory receptor comprising specific to an HLA-A*02 antigen.

17. The polynucleotide system of claim 16, comprising a sequence encoding an shRNA specific to B2M.

18. A vector comprising the polynucleotide system of claim 16.

19. A method of treating a MSLN+ cancer in a subject identified as having or suspected of having a loss of heterozygosity at an allele encoding a HLA-A*02 antigen in the MSLN-positive cancer, comprising administering to the subject the immune cells of claim 1.

20. The method of claim 19, wherein the cancer is mesothelioma, ovarian cancer, cervical cancer, colorectal cancer, esophageal cancer, head and neck cancer, kidney cancer, uterine cancer, gastric cancer, pancreatic cancer, lung cancer, colorectal cancer, or cholangiocarcinoma.

21. The method of claim 19, wherein the HLA-A*02 antigen is expressed by healthy cells of a subject.

22. The method of claim 19 wherein healthy cells of the subject express both a MSLN antigen and the HLA-A*02 antigen.

23. A method of selectively killing MSLN-positive tumor cells having loss of heterozygosity at an allele encoding an HLA-A*02 non-target antigen in the MSLN-positive cancer, the method comprising contacting the MSLN-positive tumor cells with the immune cells of claim 1.

24. The method of claim 23, wherein the tumor cell is in a tissue.

25. The method of claim 23, wherein the tumor cell is in a mixed culture.

26. A kit comprising the immune cell of claim 1.

27. The kit of claim 26, further comprising instructions for use.

* * * * *